(12) United States Patent
Madison et al.

(10) Patent No.: US 12,331,334 B2
(45) Date of Patent: Jun. 17, 2025

(54) MODIFIED UROKINASE-TYPE PLASMINOGEN ACTIVATOR POLYPEPTIDES AND METHODS OF USE

(71) Applicant: Vertex Pharmaceuticals Incorporated, Boston, MA (US)

(72) Inventors: Edwin L. Madison, San Francisco, CA (US); Christopher Thanos, Tiburon, CA (US); Vanessa Soros, San Francisco, CA (US); Mikhail Popkov, San Diego, CA (US); Kimberly Tipton, Boston, MA (US); Matthew John Traylor, Boulder, CO (US); Eric Steven Furfine, Lincoln, MA (US); Jeffrey Charles Way, Cambridge, MA (US)

(73) Assignee: Vertex Pharmaceuticals, Incorporated, Boston, MA (US)

( * ) Notice: Subject to any disclaimer, the term of this patent is extended or adjusted under 35 U.S.C. 154(b) by 159 days.

(21) Appl. No.: 18/167,534

(22) Filed: Feb. 10, 2023

(65) Prior Publication Data
US 2023/0242895 A1     Aug. 3, 2023

Related U.S. Application Data

(60) Division of application No. 16/734,256, filed on Jan. 3, 2020, now Pat. No. 11,613,744, which is a continuation of application No. PCT/US2019/068839, filed on Dec. 27, 2019.

(60) Provisional application No. 62/786,302, filed on Dec. 28, 2018.

(51) Int. Cl.
*C12N 9/72*     (2006.01)
*A61K 38/00*     (2006.01)
*C07K 14/765*     (2006.01)

(52) U.S. Cl.
CPC .......... *C12N 9/6462* (2013.01); *C07K 14/765* (2013.01); *C12Y 304/21073* (2013.01); *A61K 38/00* (2013.01); *C07K 2319/02* (2013.01); *C07K 2319/50* (2013.01)

(58) Field of Classification Search
None
See application file for complete search history.

(56) References Cited

U.S. PATENT DOCUMENTS

| | | | |
|---|---|---|---|
| 4,002,531 A | 1/1977 | Royer | 195/68 |
| 4,044,126 A | 8/1977 | Cook et al. | 424/243 |
| 4,179,337 A | 12/1979 | Davis et al. | 195/63 |
| 4,364,923 A | 12/1982 | Cook et al. | 424/46 |
| 4,414,209 A | 11/1983 | Cook et al. | 424/243 |
| 4,522,811 A | 6/1985 | Eppstein et al. | 514/2 |
| 4,751,180 A | 6/1988 | Cousens et al. | 435/68 |
| 4,892,538 A | 1/1990 | Aebischer et al. | 604/891.1 |
| 4,935,233 A | 6/1990 | Bell et al. | 424/85.5 |
| 4,952,496 A | 8/1990 | Studier et al. | 435/91 |
| 4,980,286 A | 12/1990 | Morgan et al. | 435/172.3 |
| 4,997,766 A | 3/1991 | Hung et al. | 435/320.1 |
| 5,122,614 A | 6/1992 | Zalipsky | 548/520 |
| 5,126,134 A | 6/1992 | Heim et al. | 424/94.64 |
| 5,183,550 A | 2/1993 | Mattiessen | 204/415 |
| 5,275,946 A | 1/1994 | Hatzenbuhler et al. | 435/226 |
| 5,283,187 A | 2/1994 | Aebischer et al. | 435/182 |
| 5,324,844 A | 6/1994 | Zalipsky | 548/520 |
| 5,446,090 A | 8/1995 | Harris | 525/54.1 |
| 5,457,035 A | 10/1995 | Baum et al. | 435/69.5 |
| 5,472,692 A | 12/1995 | Liu et al. | 424/94.63 |
| 5,571,708 A | 11/1996 | Yang et al. | 435/215 |
| 5,580,559 A | 12/1996 | Rajput et al. | 424/94.63 |
| 5,612,460 A | 3/1997 | Zalipsky | 530/391.9 |
| 5,643,575 A | 7/1997 | Martinez et al. | 424/194.1 |
| 5,648,253 A | 7/1997 | Wei | 435/215 |
| 5,656,726 A | 8/1997 | Rosenberg et al. | 530/326 |
| 5,672,662 A | 9/1997 | Harris et al. | 525/408 |

(Continued)

FOREIGN PATENT DOCUMENTS

| | | |
|---|---|---|
| CN | 1592634 A | 3/2005 |
| EP | 0 266 032 | 5/1988 |

(Continued)

OTHER PUBLICATIONS

Letter/Written Disclosure of the Supplemental Information Disclosure Statement for the above-referenced application, filed herewith on Nov. 15, 2024, 2 pages.

(Continued)

*Primary Examiner* — Anand U Desai

(74) *Attorney, Agent, or Firm* — Womble Bond Dickinson (US) LLP; Stephanie Seidman

(57) ABSTRACT

Provided are nucleic acid molecules, including vectors and plasmids, encoding modified u-PA polypeptides and fusion proteins containing the modified u-PA polypeptides. The u-PA polypeptides are modified to have altered activity and/or specificity so that they cleave a complement protein, such as complement protein C3, to thereby inhibit complement activation. The nucleic acids and encoded modified u-PA polypeptides and fusion proteins that inhibit complement activation can be used for treatment of diseases and conditions that are mediated by complement activation, or in which complement activation plays a role. These disorders include ischemic and reperfusion disorders, including myocardial infarction and stroke, sepsis, autoimmune diseases, diabetic retinopathies, age-related macular degeneration, transplanted organ rejection, inflammatory diseases and diseases with an inflammatory component.

65 Claims, 4 Drawing Sheets
Specification includes a Sequence Listing.

(56) References Cited

U.S. PATENT DOCUMENTS

| | | |
|---|---|---|
| 5,728,564 A | 3/1998 | Sambrook et al. ............. 435/215 |
| 5,759,542 A | 6/1998 | Gurewich ................... 424/94.64 |
| 5,766,581 A | 6/1998 | Bartley et al. ................ 424/85.1 |
| 5,795,569 A | 8/1998 | Bartley et al. ................ 424/85.1 |
| 5,808,096 A | 9/1998 | Zalipsky .......................... 548/520 |
| 5,811,252 A | 9/1998 | Verheijen ......................... 435/23 |
| 5,891,664 A | 4/1999 | Dano et al. .................... 435/69.1 |
| 5,900,461 A | 5/1999 | Harris ........................ 525/54.11 |
| 5,919,455 A | 7/1999 | Greenwald et al. ........ 424/178.1 |
| 5,932,213 A | 8/1999 | Dawson et al. ............ 424/94.64 |
| 5,932,462 A | 8/1999 | Harris et al. .................... 435/188 |
| 5,980,886 A | 11/1999 | Kay et al. ................... 424/93.21 |
| 5,985,263 A | 11/1999 | Lee et al. ..................... 424/85.2 |
| 5,990,237 A | 11/1999 | Bentley et al. .............. 525/54.2 |
| 6,113,906 A | 9/2000 | Greenwald et al. ........ 424/194.1 |
| 6,214,966 B1 | 4/2001 | Harris ............................. 528/322 |
| 6,248,712 B1 | 6/2001 | Dano et al. ......................... 514/2 |
| 6,248,715 B1 | 6/2001 | Rosenberg et al. ............. 514/12 |
| 6,258,351 B1 | 7/2001 | Harris .......................... 424/78.3 |
| 6,340,742 B1 | 1/2002 | Burg et al. ...................... 530/351 |
| 6,413,507 B1 | 7/2002 | Bentley et al. ............. 424/78.02 |
| 6,420,339 B1 | 7/2002 | Gegg et al. ...................... 514/12 |
| 6,423,685 B1 | 7/2002 | Drummond et al. ........... 514/12 |
| 6,437,025 B1 | 8/2002 | Harris et al. ..................... 523/406 |
| 6,448,369 B1 | 9/2002 | Bentley et al. ................ 528/425 |
| 6,461,802 B1 | 10/2002 | Van Thillo et al. .......... 430/336 |
| 6,495,659 B2 | 12/2002 | Bentley et al. ................ 528/425 |
| 6,737,505 B2 | 5/2004 | Bentley et al. ................ 528/425 |
| 6,828,401 B2 | 12/2004 | Nho et al. ........................ 526/333 |
| 6,858,736 B2 | 2/2005 | Nho et al. ....................... 546/290 |
| 7,074,401 B2 | 7/2006 | Gurewich et al. ......... 424/94.63 |
| 7,179,461 B2 | 2/2007 | Silver et al. ................ 424/94.63 |
| 7,807,457 B2 | 10/2010 | Armendariz Borunda et al. ........ 435/325 |
| 7,811,771 B2 | 10/2010 | Verheijen et al. ............. 435/7.1 |
| 8,211,428 B2 | 7/2012 | Madison .................... 424/94.64 |
| 9,255,155 B2 | 2/2016 | Sevillano et al. .......... 424/158.1 |
| 2001/0021763 A1 | 9/2001 | Harris ............................. 528/75 |
| 2001/0044526 A1 | 11/2001 | Shen ............................... 530/409 |
| 2001/0046481 A1 | 11/2001 | Bentley et al. .............. 424/78.18 |
| 2002/0052430 A1 | 5/2002 | Harris et al. ..................... 523/406 |
| 2002/0072573 A1 | 6/2002 | Bentley et al. ................ 525/409 |
| 2002/0106775 A1 | 8/2002 | Wang et al. .................... 435/215 |
| 2002/0156047 A1 | 10/2002 | Zhao ............................... 514/58 |
| 2003/0114647 A1 | 6/2003 | Harris et al. ..................... 530/402 |
| 2003/0143596 A1 | 7/2003 | Bentley et al. ..................... 435/6 |
| 2003/0158333 A1 | 8/2003 | Roberts et al. ............. 525/54.11 |
| 2003/0220447 A1 | 11/2003 | Harris ........................... 525/54.1 |
| 2004/0013637 A1 | 1/2004 | Bentley et al. ............. 424/78.17 |
| 2004/0146938 A1 | 7/2004 | Nguyen et al. ................. 435/7.1 |
| 2004/0175777 A1 | 9/2004 | Harris et al. ..................... 435/23 |
| 2004/0235734 A1 | 11/2004 | Bossard et al. ............... 530/383 |
| 2004/0265298 A1 | 12/2004 | Lin ............................ 424/94.64 |
| 2005/0114037 A1 | 5/2005 | Desjarlais et al. ............... 702/19 |
| 2005/0171328 A1 | 8/2005 | Harris ........................... 528/322 |
| 2005/0209416 A1 | 9/2005 | Harris ........................... 525/523 |
| 2005/0260756 A1 | 11/2005 | Troy et al. ..................... 435/458 |
| 2006/0024289 A1 | 2/2006 | Ruggles et al. ............ 424/94.64 |
| 2006/0024298 A1 | 2/2006 | Lazar et al. ................ 424/133.1 |
| 2006/0100134 A1 | 5/2006 | Guo et al. ....................... 514/2 |
| 2006/0104968 A1 | 5/2006 | Bookbinder et al. ....... 424/94.61 |
| 2006/0142195 A1 | 6/2006 | Medcalf ........................ 514/12 |
| 2006/0178297 A1 | 8/2006 | Troy et al. ........................ 514/7 |
| 2006/0194265 A1 | 8/2006 | Morris et al. ................. 435/7.23 |
| 2006/0222657 A1 | 10/2006 | Dowdy et al. ............... 424/186.1 |
| 2007/0129305 A1 | 6/2007 | Divita et al. .................... 514/13 |
| 2007/0161595 A1 | 7/2007 | Bumcrot et al. ................ 514/44 |
| 2008/0020416 A1 | 1/2008 | McAlister et al. ............. 435/23 |
| 2009/0010916 A1 | 1/2009 | Gurewich et al. ......... 424/94.63 |
| 2009/0123452 A1 | 5/2009 | Madison .................... 424/94.64 |
| 2011/0053787 A1 | 3/2011 | Brulliard et al. ............... 506/13 |
| 2011/0055940 A1 | 3/2011 | Reed et al. ..................... 800/15 |
| 2013/0136731 A1 | 5/2013 | Maheshwari et al. ........... 435/77 |
| 2013/0165344 A1 | 6/2013 | Anderberg et al. ............. 506/7 |
| 2014/0079630 A1 | 3/2014 | Smith et al. ................. 424/1.61 |
| 2014/0242062 A1 | 8/2014 | Madison et al. ........... 424/94.64 |
| 2015/0023959 A1 | 1/2015 | Chhabra .................... 424/134.1 |
| 2015/0190482 A1 | 7/2015 | Higazi et al. .............. 424/94.64 |
| 2016/0200831 A1 | 7/2016 | Pritsker et al. ............. 424/133.1 |
| 2021/0222143 A9 | 7/2021 | Madison et al. ........... 424/94.64 |

FOREIGN PATENT DOCUMENTS

| | | |
|---|---|---|
| EP | 0 336 508 | 10/1989 |
| EP | 0 387 380 | 9/1990 |
| EP | 0 822 199 | 9/2004 |
| EP | 1 064 951 | 8/2007 |
| EP | 1 867 661 | 12/2007 |
| ES | 2 932 777 | 1/2023 |
| JP | 2009-512451 A | 3/2009 |
| JP | 2009-542218 A | 12/2009 |
| KR | 20110099421 A | 9/2011 |
| WO | WO 1988/008451 | 11/1988 |
| WO | WO 1989/010401 | 11/1989 |
| WO | WO 1990/004635 | 5/1990 |
| WO | WO 1991/002057 | 2/1991 |
| WO | WO 1993/010151 | 5/1993 |
| WO | WO 1994/028145 | 8/1994 |
| WO | WO 1994/028024 | 12/1994 |
| WO | WO 1996/013160 | 5/1996 |
| WO | WO 2000/062067 | 10/2000 |
| WO | WO 2001/032711 | 5/2001 |
| WO | WO 2001/076640 | 10/2001 |
| WO | WO 2001/087925 | 11/2001 |
| WO | WO 2002/040503 | 5/2002 |
| WO | WO 2002/049673 | 6/2002 |
| WO | WO 2003/035892 | 5/2003 |
| WO | WO 2005/000360 | 1/2005 |
| WO | WO 2005/063816 | 7/2005 |
| WO | WO 2007/047995 | 4/2007 |
| WO | WO 2007/053512 | 5/2007 |
| WO | WO 2007/097561 | 8/2007 |
| WO | WO 2008/045148 | 4/2008 |
| WO | WO 2015/116933 | 8/2015 |

OTHER PUBLICATIONS

Office Action, issued Aug. 31, 2024, in connection with Chinese Patent Application No. 201980093212.X [English translation of Office Action and original document in Chinese], 7 pages.

Response, filed Oct. 1, 2024, to Office Action, received Jul. 9, 2024, in connection with Egyptian Patent Application 2021060977 [English instructions for response, response as filed in Arabic, and English language translation of claims as filed], 143 pages.

Decition to Grant, issued Oct. 15, 2024, in connection with Japanese Patent Application No. 2021-538046 [English reporting letter and decision as issued in Japanese], 6 pages.

Clear Examination Report (Notice of Allowance), issued Jul. 25, 2024, in connection with Malaysian Patent Application No. PI2021003370, 1 page.

Office Action, issued Nov. 6, 2024, in connection with Korean Patent Application No. 10-2021-7023898, 10 pages [Original document in Korean and English translation].

Letter/Written Disclosure of the Supplemental Information Disclosure Statement for the above-referenced application, filed herewith on Dec. 13, 2023, 2 pages.

Response, filed Oct. 2, 2023, to Examiner's Report, issued Jun. 2, 2023, in connection with Canadiant Patent Application No. 3,123,872, 131 pages.

Office Action, issued Sep. 27, 2023, in connection with Indonesian Patent Application No. P00202105762 [English Translation of the Offical Action and original document in Indonesian], 7 pages.

Office Action, issued Nov. 28, 2023, in connection with Japanese Patent Application No. 2021-538046 [English translation of Office Action and original document as issued in Japanese], 16 pages.

Response, filed Jul. 18, 2023, to Search Report and Written Opinion, issued Feb. 22, 2023, in connection with Singapore Patent Application No. 11202106244R, 54 pages.

Letter/Written Disclosure of the Supplemental Information Disclosure Statement for the above-referenced application, filed herewith on Jul. 31, 2024, 2 pages.

(56) References Cited

OTHER PUBLICATIONS

Notice of Allowance, mailed Mar. 22, 2024, in connection with Canadian Patent Application No. 3,123,872, 1 page.
Response, filed Mar. 25, 2024, to Search Report and Written Opinon, issued Dec. 26, 2023, in connection with Chilean Application No. 202101710 [English language instructions for response, English language translation of filed claims and response as filed in Spanish], 189 pages.
Response, filed Jun. 16, 2024, to Office Action, issued Dec. 1, 2023, in connection with Chinese Patent Application No. 201980093212.X [English language instructions for response, English language translation of filed claims and response as filed in Chinese], 110 pages.
Response, filed Jun. 24, 2024, in connection with Colombian Patent Application No. NC2021/0008338 [English language instructions for Response, English language translation of claims as filed, and Response as filed in Spanish], 566 pages.
Office Action, received Mar. 21, 2024, in connection with Eurasian Patent Appln No. 202100200 [English language translation of Office Action], 3 pages.
Office Action, received Jul. 9, 2024, in connection with Egypt Patent Application 2021060977 [English language translation and office action as issued in Arabic], 13 pages.
Response and Written Statement, filed May 28, 2024 and Jun. 11, 2024, in connection with Japanese Patent Application No. 2021-538046 [English instructions for response, English language translation of claims as filed, response as filed in Japanese, and written statement as filed in Japanese], 200 pages.
Notice of Allowance, mailed Jun. 20, 2024, in connection with Singapore Patent Application No. 11202106244R, 2 pages.
Letter/Written Disclosure of the Information Disclosure Statement for the above-referenced application, filed herewith on Apr. 18, 2023, 2 pages.
Catalyst Biosciences Presentation, entitled "Company Overview," Published Jun. 2, 2014 [online]; retrieved on Nov. 29, 2016 from: <URL:ir.catalystbiosciences.com/phoenix.zhtml?c=254141&p=irol-newsArticle&ID=2192374, 19 pages.
Catalyst Biosciences, United States Securities and Exchange Commission filing, dated Mar. 9, 2016; retrieved on Jul. 31, 2018, from: <URL:sec.gov/Archives/edgar/data/1124105/000119312516498295/d117011d10k.htm, 109 pages.
Catalyst BiosciencesPresentation, entitled "Company Overview," Published May 2016 [online]; retrieved on Jan. 17, 2017, from: <URL:ir.catalystbiosciences.com/phoenix.zhtml?c=254141&p=irol-calendar, 25 pages.
Catalyst Biosciences Presentation, presented at the Jefferies 2016 Complement Therapeutics Summit in New York City, on May 3, 2016, 22 pages.
Catalyst Biosciences Presentation, entitled "Anti-Complement (C3) for Dry AMD," Presented at the Opthalmology Innovation Summit meeting, at the American Society of Retina Specialists on Aug. 8, 2016, San Francisco, CA., 8 pages.
Catalyst Biosciences Presentation, entitled "Anti-Complement (C3) for Dry AMD," Presented on Dec. 13, 2016, 21 pages.
Catalyst Biosciences, United States Securities and Exchange Commission filing, dated Mar. 8, 2017 [online]; retrieved on Jul. 31, 2018, from: <URL:sec.gov/Archives/cdgar/data/1124105/0001564590170037229/cbio-10k_20161231.htm, 122 pages.
Catalyst Biosciences, United States Securities and Exchange Commission filing, dated Mar. 13, 2017 [online]; retrieved on Aug. 1, 2018, from: <URL:sec.gov/Archives/edgar/data/1124105/000119312517080510/d358624ds1.htm, 79 pages.
Catalyst Biosciences Press Release, entitled "Catalyst Biosciences and Mosaic Biosciences Enter into Strategic Collaboration to Develop Intravitreal Anti-Complement Factor 3 (C3) Products for the Treatment of Dry AMD and Other Retinal Diseases," published Oct. 24, 2017 [online]; retrieved on Jan. 30, 2018 from: < URL:ir.catalystbiosciences.com/phoenix.zhtml?c=254141&p=irol-newsArticle_print&ID=2310657, 3 pages.

Catalyst Biosciences, United States Securities and Exchange Commission filing, dated Mar. 19, 2018; retrieved on Jul. 30, 2018, from: <URL:getfilings.com/sec-filings/180319/CATALYST-BIOSCIENCES-INC_10-K/, 132 pages.
Catalyst Biosciences, United States Securities and Exchange Commission filing, dated May 3, 2018; retrieved on Jul. 31, 2018, from: <URL:getfilings.com/sec-filings/180503/CATALYST-BIOSCIENCES-INC_10-Q/, 32 pages.
Catalyst Biosciences, United States Securities and Exchange Commission filing, dated Mar. 7, 2019; retrieved on Mar. 28, 2019, from: <URL:ir.catalystbiosciences.com/static-files/3ab468bc-227c-46e5-8598-54025b55f93a, 155 pages.
Catalyst Biosciences Presentation, entitled "Corporate Overview," presented on Apr. 9, 2019; retrieved on Aug. 1, 2019 from: <URL:ir.catalystbiosciences.com/static-filcs/96f2c8ad-6334-4f5c-89e4-a0df25aaf1c7, 27 pages.
Catalyst Biosciences Press Release, entitled "Catalyst Biosciences Reports First Quarter 2019 Operating & Financial Results and Provides a Corporate Update," Published May 2, 2019 [online]; retrieved on Aug. 1, 2019 from <URL:ir.catalystbiosciences.com/news-releases/news-release-details/catalyst-biosciences-reports-first-quarter-2019-operating, 5 pages.
Catalyst Biosciences, United States Securities and Exchange Commission filing, dated May 2, 2019; retrieved on Aug. 1, 2019, from: <URL:ir.catalystbiosciences.com/static-files/839f0b21-034a-46c1-93d6-b02a9df870cf, 28 pages.
Catalyst Biosciences Press Release, entitled "Catalyst Biosciences Reports Third Quarter 2019 Operating & Financial Results and Provides a Corporate Update," Published Nov. 7, 2019 [online]; retrieved on Jan. 24, 2020, from: <URL:ir.catalystbiosciences.com/news-releases/news-release-details/catalyst-biosciences-reports-third-quarter-2019-operating, 6 pages.
Catalyst Biosciences Investor Presentation, entitled "Corporate Overview," presented on Jan. 8, 2020, 26 pages.
Catalyst Biosciences Investor Presentation, entitled "Corporate Overview," presented on Jan. 13, 2020, 31 pages.
Catalyst Biosciences Press Release, entitled "Catalyst Biosciences Announces Addition of Geoffrey Shiu Fei Ling, M.D. and Sharon Tetlow to Board of Directors," Published Jan. 17, 2020 [online]; retrieved on Jan. 24, 2020 from: <URL:ir.catalystbiosciences.com/news-releases/news-release-details/catalyst-biosciences-announces-addition-geoffrey-shiu-fei-ling, 3 pages.
Catalyst Biosciences Press Release, entitled "Catalyst Biosciences Announces Proposed Public Offering of Common Stock. " Published Feb. 12, 2020 [online]; retrieved on Mar. 11, 2020 from: <URL:ir.catalystbiosciences.com/news-releases/news-release-details/catalyst-biosciences-announces-proposed-public-offering-common-1, 2 pages.
Catalyst Biosciences Press Release, entitled "Catalyst Biosciences Announces Pricing of Public Offering of Common Stock." Published Feb. 13, 2020 [online]; retrieved on Mar. 11, 2020 from: <URL:http://ir.catalystbiosciences.com/news-releases/news-release-details/catalyst-biosciences-announces-pricing-public-offering-common-1, 3 pages.
Catalyst Biosciences Press Release, entitled "Catalyst Biosciences Announces Closing of Public Offering of Common Stock." Published Feb. 18, 2020 [online]; retrieved on Mar. 11, 2020 from: <URL:ir.catalystbiosciences.com/news-releases/news-release-details/catalyst-biosciences-announces-closing-public-offering-common-1, 2 pages.
Catalyst Biosciences Press Release, entitled "Catalyst Biosciences Reports Fourth Quarter and Full-Year 2019 Operating & Financial Results and Provides a Corporate Update." Published Feb. 20, 2020 [online]; retrieved on Mar. 11, 2020, from: <URL:ir.catalystbiosciences.com/news-releases/news-release-details/catalyst-biosciences-reports-fourth-quarter-and-full-year-2019, 6 pages.
Catalyst Biosciences Investor Presentation, entitled "Corporate Overview." Presented on Jan. 26, 2021, 34 pages.
Catalyst Biosciences Investor Presentation, entitled "Corporate Overview." Presented on Mar. 3, 2021, at the 42nd Annual Raymond James Institutional Investors Conference, 34 pages.

(56) References Cited

OTHER PUBLICATIONS

Adams et al., "The c-myc oncogene driven by immunoglobulin enhancers induces lymphoid malignancy in transgenic mice," Nature 318:533-538 (1985).
Ahmad et al., "scFv Antibody: Principles and Clinical Application," Clin. Dev. Immunol. 2012:980250 (2012), 15 pages.
Akkarawongsa et al., "Inhibition of Herpes Simplex Virus Type 1 Infection by Cationic β-Peptides," Antimicrob. Agents and Chemother. 52(6):2120-2129 (2008).
AlQahtani et al., "Strategies for the production of long-acting therapeutics and efficient drug delivery for cancer treatment," Biomed. Pharmacother. 113:108750 (2019), 13 pages.
Alexander et al., "Expression of the c-myc oncogene under control of an immunoglobulin enhancer in Eμ-myc transgenic mice," Mol. Cell. Biol. 7(4):1436-1444 (1987).
Andersen et al., "A cyclic peptidylic inhbitor of murine urokinase-type plasminogen activator: changing species specificity by substitution of a single residue," Biochem. J. 412:447-457 (2008).
Anderson et al., "A Role for Local Inflammation in the Formation of Drusen in the Aging Eye," Am. J. Ophthalmol. 134:411-431 (2002).
Anderson et al., "The Pivotal Role of the Complement System in Aging and Age-related Macular Degeneration: Hypothesis Revisited," Prog. Retin. Eye Res. 29(2):95-112 (2010).
Anderson et al., "Activation of the furin endoprotease is a multiple-step process: requirements for acidification and internal propeptide cleavage," EMBO J. 16(7):1508-1518 (1997).
Andreasen et al., "The plasminogen activation system in tumor growth, invasion, and metastasis," Cell. Mol. Life Sci. 57(1):25-40 (2000).
Appella et al., "The receptor-binding sequence of urokinase. A biological function for the growth-factor module of proteases," J. Biol. Chem. 262(10):4437-4440 (1987).
Asgari et al., "Complement in organ transplantation," Curr. Opin. Organ Transplant. 15(4):486-491 (2010).
Austen et al., "The role of complement and natural antibody in intestinal ischemia-reperfusion injury," Int. J. Immunopathol. Pharmacol. 16(1):1-8 (2003).
Backes et al., "Synthesis of positional-scanning libraries of fluorogenic peptide substrates to define the extended substrate specificity of plasmin and thrombin," Nat. Biotechnol. 18(2):187-193 (2000).
Bamford et al., "The 5' untranslated region, signal peptide, and the coding sequence of the carboxyl terminus of IL-15 participate in its multifaceted translational control," J. Immunol. 160(9):4418-4426 (1998).
Barrett, A.J., "An introduction to the proteinases," In: Proteinase Inhibitors, Barrett, A.J. and Salvensen, G., eds., Elsevier, Amsterdam, pp. 3-22 (1986).
Bass et al., "Cellular mechanisms regulating non-haemostatic plasmin generation," Biochem. Soc. Trans. 30:189-194 (2002).
Bdeir et al., "The kringle stabilizes urokinase binding to the urokinase receptor," Blood 102(10):3600-3608 (2003).
Benhar et al., "Pseudomonas Exotoxin A Mutants. Replacement of surface-exposed residues in domain III with cysteine residues that can be modified with polyethylene glycol in a site-specific manner," J. Biol. Chem. 269(18):13398-13404 (1994).
Benoist et al., "In vivo sequence requirements of the SV40 early promoter region," Nature 290:304-310 (1981).
Bergstrom et al., "Binding of nonphysiological protein and peptide substrates to proteases: differences between urokinase-type plasminogen activator and trypsin and contributions to the evolution of regulated proteolysis," Biochemistry 42(18):5395-5402 (2003).
Bhole et al., "Therapeutic potential of targeting the complement cascade in critical care medicine," Crit. Care Med. 31(Suppl. 1):S97-S104 (2003).
Bitter et al., "Expression and Secretion Vectors for Yeast," Methods Enzymol. 153:516-544 (1987).
Blasi, F. and Carmeliet, P., "uPAR: a versatile signalling orchestrator," Nat. Rev. Mol. Cell Biol. 3(12):932-943 (2002).

Blouse et al., "A Novel Mode of Intervention with Serine Protease Activity: Targeting Zymogen Activation," J. Biol. Chem. 284(7):4647-4657 (2009).
Botkjaer et al., "Nonproteolytic induction of catalytic activity into the single-chain form of urokinase-type plasminogen activator by dipeptides," Biochemistry 48(40):9606-9617 (2009).
Boutaud, A. and Castellino, F.J., "The construction and expression of chimeric urokinase-type plasminogen activator genes containing kringle domains of human plasminogen," Arch. Biochem. Biophys. 303:222-230 (1993).
Bradley et al., "Complement in age-related macular degeneration: a focus on function," Eye 25:683-693 (2011).
Brinster et al., "Regulation of metallothionein-thymidine kinase fusion plasmids injected into mouse eggs," Nature 296:39-42 (1982).
Brumeanu et al., "Derivatization with Monomethoxypolyethylene Glycol of Igs Expressing Viral Epitopes Obviates Adjuvant Requirements," J. Immunol. 154:3088-3095 (1995).
Buerke et al., "Novel small molecule inhibitor of Cls exerts cardioprotective effects in ischemia-reperfusion injury in rabbits," J. Immunol. 167:5375-5380 (2001).
Buko et al., "Characterization of a posttranslational fucosylation in the growth factor domain of urinary plasminogen activator," Proc. Natl. Acad. Sci. USA 88:3992-3996 (1991).
Burdukiewicz et al., "Prediction of Signal Peptides in Proteins from Malaria Parasites," Int. J. Mol. Sci. 19(12):3709 (2018), 16 pages.
Buyon et al., "Assessment of disease activity and impending flare in patients with systemic lupus erythematosus. Comparison of the use of complement split products and conventional measurements of complement," Arthritis Rheum. 35(9):1028-1037 (1992).
Caliceti P., and F. M. Veronese, "Pharmacokinetic and biodistribution properties of poly(ethylene glycol)-protein conjugates," Adv. Drug Deliv. Rev. 55(10):1261-1277 (2003).
Carricro et al., "Inhibition of receptor-dependent urokinase signaling by specific Ser to Glu substitutions," Biol. Chem. 383(1):107-113 (2002).
Carrillo H., and D. Lipman, "The multiple sequence alignment problem in biology," SIAM J. Appl. Math. 48:1073-1082 (1988).
Castellano et al., "Therapeutic Targeting of Classical and Lectin Pathways of Complement Protects from Ischemia-Reperfusion-Induced Renal Damage," Am. J. Pathol. 176(4):1648-1659 (2010).
Chapman et al., "Therapeutic antibody fragments with prolonged in vivo half-lives," Nat. Biotechnol. 17(8):780-783 (1999).
Chi et al., "Chapter 9. Suppression of Drusen Formation by Compstatin, a Peptide Inhibitor of Complement C3 activation, on Cynomolgus Monkey with Early-Onset Macular Degeneration," Adv. Exp. Med. Biol. 703:127-135 (2010).
Coffey et al., "Complement factor H deficiency in aged mice causes retinal abnormalities and visual dysfunction," Proc. Nat. Acad. Sci. 104(42):16651-16656 (2007).
Colbere-Garapin et al., "A New Dominant Hybrid Selective Marker for Higher Eukaryotic Cells," J. Mol. Biol. 150:1-14 (1981).
Couser et al., "The effects of soluble recombinant complement receptor 1 on complement-mediated experimental glomerulonephritis," J. Am. Soc. Nephrol. 5(11):1888-1894 (1995).
Crabb et al., "Drusen proteome analysis: An approach to the etiology of age-related macular degeneration," Proc. Natl. Acad. Sci. 99(23):14682-14687 (2002).
Crowley et al., "Prevention of metastasis by inhibition of the urokinase receptor," Proc. Natl. Acad. Sci. USA 90(11):5021-5025 (1993).
Damman et al., "Local renal complement C3 induction by donor brain death is associated with reduced renal allograft function after transplantation," Nephrol. Dial. Transplant. 26(7):2345-2354 (2011).
Danobeitia et al., "Complement Blockade Prevents Delayed Graft Function in a Non-Human Primate Model of Kidney Allo-Transplantation," Abstract No. 119, Am. J. Transplant. 13 (suppl 5), American Transplant Congress, May 18-22, 2013, Seattle, Washington, 4 pages.
Davidow et al., "Mutations affecting the activity of urokinase-type plasminogen activator," Protein Eng. 4(8):923-928 (1991).
De Boer et al., "The tac promoter: a functional hybrid derived from the trp and lac promoters," Proc. Natl. Acad. Sci. USA 80:21-25 (1983).

(56) References Cited

OTHER PUBLICATIONS

Deng et al., "Projecting human pharmacokinetics of therapeutic antibodies from nonclinical data," mAbs 3(1):61-66 (2011).
Derossi et al., "Cell Internalization of the Third Helix of the Antennapedia Homeodomain Is Receptor-independent," J. Biol. Chem. 271(30):18188-18193 (1996).
Draize et al., "Methods for the study of irritation and toxicity of substances applied topically to the skin and mucous membranes". J. Pharmacol. Exp. Ther. 82:377-390 (1944).
Edwards et al., "Complement Factor H Polymorphism and Age-Related Macular Degeneration," Science 308(5720):421-424 (2005).
Eguchi et al., "Characterization of thrombin-and plasmin-resistant mutants of recombinant human single chain urokinase-type plasminogen activator," J. Biochem. 108:72-79 (1990).
Ehnman et al., "The uPA/uPAR system regulates the bioavailability of PDGF-DD: implications for tumour growth," Oncogene 28(4):534-544 (2009).
Elliott, G., and P. O'Hare, "Intercellular Trafficking and Protein Delivery by a Herpesvirus Structural Protein," Cell 88:223-233 (1997).
Englebienne, P., "Use of colloidal gold surface plasmon resonance peak shift to infer affinity constants from the interactions between protein antigens and antibodies specific for single or multiple epitopes," Analyst 123:1599-1603 (1998).
Evan et al., "Isolation of Monoclonal Antibodies Specific for Human c-myc Proto-Oncogene Product," Mol. Cell. Biol. 5(12):3610-3616 (1985).
Felix et al., "Pegylated peptides IV. Enhanced biological activity of site-directed pegylated GRF analogs," Int. J. Peptide Protein Res. 46:253-264 (1995).
Fiane et al., "Compstatin, a peptide inhibitor of C3, prolongs survival of ex vivo perfused pig xenographs," Xenotransplantation 6:52-65 (1999).
Field et al., "Purification of a RAS-Responsive Adenylyl Cyclase Complex from *Saccharomyces cerevisiae* by Use of an Epitope Addition Method," Mol. Cell. Biol. 8(5):2159-2165 (1988).
Fletcher et al., "Studying Age-Related Macular Degeneration Using Animal Models," Optm. Vis. Sci. 91(8):878-886 (2014).
Forest et al., "Cellular models and therapies for age-related macular degeneration," Disease Models and Mechanisms 8(5):421-427 (2015).
Franco et al., "Phosphorylation of Human Pro-Urokinase on Ser$^{138/303}$ Impairs Its Receptor-dependent Ability to Promote Myelomonocytic Adherence and Motility," J. Cell. Biol. 137(3):779-791 (1997).
Franco et al., "Protein kinase C-dependent in vivo phosphorylation of prourokinase leads to the formation of a receptor competitive antagonist," J. Biol. Chem. 273(42):27734-27740 (1998).
Futaki et al., "Arginine-rich peptides. An abundant source of membrane-permeable peptides having potential as carriers for intracellular protein delivery," J. Biol. Chem. 276(8):5836-5840 (2001).
Futaki et al., "Membrane permeability commonly shared among arginine-rich peptides," J. Mol. Recognit. 16:260-264 (2003).
Gaboriaud et al., "The crystal structure of the globular head of complement protein C1q provides a basis for its versatile recognition properties," J. Biol. Chem. 278(47):46974-46982 (2003).
Gardner et al., "The complete nucleotide sequence of an infectious clone of cauliflower mosaic virus by M13mp7 shotgun sequencing," Nucleic Acids Res. 9(12):2871-2888 (1981).
Gass, J. D. M., "Drusen and disciform macular detachment and degeneration, " Trans. Am. Ophthalmol. Soc. 70: 409-436 (1972).
Gemenetzi, M. and A.J. Lotery, "Complement pathway biomarkers and age-related macular degeneration," Eye 30:1-14 (2016).
Genbank Accession No. AAY78493.1, "low molecular weight pro-urokinase, partial [synthetic construct]," Published on Jul. 26, 2016 [online] [retrieved on Apr. 8, 2022] from: <URL:https://www.ncbi.nlm.nih.gov/protein/AAY78493.1, 2 pages.
Ghosh et al., "Role of Complement and Complement Regulatory Proteins in the Complications of Diabetes," Endocr. Rev. 36:272-288 (2015).
Gilbert et al., "Useful proteins from recombinant bacteria, " Sci. Am. 242:74-94 (1980).
Glockshuber et al., "A comparison of strategies to stabilize immunoglobulin $F_v$-fragments," Biochemistry 29(6):1362-1367 (1990).
Gold et al., "Variation in factor B (BF) and complement component 2 (C2) genes is associated with age-related macular degeneration," Nat. Genet. 38(4):458-462 (2006).
Gribskov et al., "Sigma factors from *E. coli*, B. subtilis, phage SP01, and phage T4 are homologous proteins, " Nucleic Acids Res. 14(16):6745-6763 (1986).
Griffin, A.M., and Griffin, H.G., eds., "Computer Analysis of Sequence Data, Part I," Humana Press, New Jersey, pp. 1-8 (1994).
Grosschedl et al., "Introduction of a μ immunoglobulin gene into the mouse germ line: specific expression in lymphoid cells and synthesis of functional antibody," Cell 38:647-658 (1984).
Guiotto et al., "An improved procedure for the synthesis of branched polyethylene glycols (PEGs) with the reporter dipeptide Met-βAla for protein conjugation," Bioorg. Med. Chem. Lett. 12(2):177-180 (2002).
Guo et al., "Neutrophil C5a receptor and the outcome in a rat model of sepsis," FASEB J. 17(13):1-17 (2003).
Guo et al., "Role of C5a in inflammatory responses," Annu. Rev. Immunol. 23:821-852 (2005).
Gurewich et al., "Characterization of the intrinsic fibrinolytic properties of pro-urokinase through a study of plasmin-resistant mutant forms produced by site-specific mutagenesis of lysine$^{158}$," J. Clin. Invest. 82(6):1956-1962 (1988).
Hack et al., "Elevated plasma levels of the anaphylatoxins C3a and C4a are associated with a fatal outcome in sepsis," Am. J. Med. 86:20-26 (1989).
Hageman et al., "A common haplotype in the complement regulatory gene factor H (HF1/CFH) predisposes individuals to age-related macular degeneration," Proc. Nat. Acad. Sci. 102(20):7227-7232 (2005).
Haines et al., "Complement Factor H Variant Increases the Risk of Age-Related Macular Degeneration," Science 308(5720):419-421 (2005).
Hammer et al., "Diversity of alpha-fetoprotein gene expression in mice is generated by a combination of separate enhancer elements," Science 235:53-58 (1987).
Hanahan, D., "Heritable formation of pancreatic β-cell tumours in transgenic mice expressing recombinant insulin/simian virus 40 oncogenes," Nature 315:115-122 (1985).
Hanto et al., "Intraoperative Administration of Inhaled Carbon Monoxide Reduces Delayed Graft Function in Kidney Allografts in Swine," Am. J. Transplant. 10(11):2421-2430 (2010).
Harris, J.M., and R.B. Chess, "Effect of pegylation on pharmaceuticals," Nat. Rev. Drug Discov. 2(3):214-221 (2003).
Harris et al., "Definition and redesign of the extended substrate specificity of granzyme B," J. Biol. Chem. 273(42):27364-27373 (1998).
Harris et al., "Rapid and general profiling of protease specificity by using combinatorial fluorogenic substrate librarics," Proc. Natl. Acad. Sci. USA 97(14):7754-7759 (2000).
Hartley, B.S., "Enzyme families," Symp. Soc. Gen. Microbiol. 24:151-182 (1974).
Hartman, S.C. and R.C. Mulligan, "Two dominant-acting selectable markers for gene transfer studies in mammalian cells," Proc. Natl. Acad. Sci. USA 85:8047-8051 (1988).
Hecke et al., "Analysis of complement proteins in polytrauma patients-correlation with injury severity, sepsis and outcome," Abstract # 291, Shock 7:74 (1997).
Hedstrom, L., "Serine Protease Mechanism and Specificity," Chem Rev. 102(12):4501-4523 (2002).
Heideman, M. and T. E. Hugli, "Anaphylatoxin generation in multisystem organ failure," J. Trauma 24(12):1038-1043 (1984).
Herrera-Estrella et al., "Expression of chimaeric genes transferred into plant cells using a Ti-plasmid-derived vector," Nature 303:209-213 (1983).
Herrera-Estrella et al., "Light-inducible and chloroplast-associated expression of a chimaeric gene introduced into Nicotiana tabacum using a Ti plasmid vector," Nature 310:115-120 (1984).
Holmskov et al., "Collectins: collagenous C-type lectins of the innate immune defense system," Immunol. Today 15(2):67-74 (1994).

(56) References Cited

OTHER PUBLICATIONS

Homandberg, G.A. and Wai, T., "Insertion of fibrin peptides into urokinase enhances fibrin affinity," Thromb. Res. 58:403-412 (1990).
Horizon Scanning Research and Intelligence Centre brief, "Eculizumab (Soliris) for prevention of delayed graft function after kidney transplantation in adult patients at increased risk—first line," Sep. 2016, retrieved on Jul. 6, 2018 from <URL:io.nihr.ac.uk/wp-content/uploads/migrated/Eculizumab-delayed-graft-function-Sep16.pdf, 8 pages.
Huang, X. and W. Miller, "A Time-Efficient, Linear-Space Local Similarity Algorithm," Adv. Appl. Math. 12:337-357 (1991).
Huber, R. and Bode, W., "Structural basis of the activation and action of trypsin," Acc. Chem. Res. 11:114-122 (1978).
Hurst et al., "Platelet-derived growth factor-C (PDGF-C) activation by serine proteases: implications for breast cancer progression," Biochem. J. 441(3):909-918 (2012).
Huston et al., "Protein engineering of antibody binding sites: recovery of specific activity in an anti-digoxin single-chain Fv analogue produced in *Escherichia coli*," Proc. Natl. Acad. Sci. USA 85(16):5879-5883 (1988).
Hwang et al., "Comparison of systemic adverse events associated with intravitreal anti-VEGF injection: ranibizumab versus bevacizumab," J. Korean Med. Sci. 27:1580-1585 (2012).
IUPAC-IUB Commission on Biochemical Nomenclature, "A one-letter notation for amino acid sequences: tentative rules," J. Biol. Chem. 243(13):3557-3559 (1968).
IUPAC-IUB Commission on Biochemical Nomenclature, "Symbols for amino-acid derivatives and peptides: recommendations (1971)," Biochem. 11(9):1726-1732 (1972).
Jager et al., "Age-Related Macular Degeneration," N. Engl. J. Med. 358:2606-2617 (2008).
Jay et al., "Construction of a general vector for efficient expression of mammalian proteins in bacteria: use of a synthetic ribosome binding site," Proc. Natl. Acad. Sci. U.S.A. 78(9):5543-5548 (1981).
Jha et al., "The Complement System and Ocular Diseases, " Mol. Immunol. 44(16):3901-3908 (2007).
Johnson, C.K. and N. Leca, "Eculizumab use in kidney transplantation," Curr. Opin. Organ Transplant. 20(6):643-651 (2015).
Johnson et al., "A Potential Role for Immune Complex Pathogenesis in Drusen Formation, " Exp. Eye Res. 70:441-449 (2000).
Johnson et al., "Complement Activation and Inflammatory Processes in Drusen Formation and Age Related Macular Degeneration," Exp. Eye Res. 73:887-896 (2001).
Johnson et al., "The Alzheimer's Aβ-peptide is deposited at sites of complement activation in pathologic deposits associated with aging and age-related macular degeneration," PNAS 99(18):11830-11835 (2002).
Kabouridis, P.S., "Biological applications of protein transduction technology," Trends Biotechnol. 21(11):498-503 (2003).
Ke et al., "Distinguishing the specificities of closely related proteases. Role of P3 in substrate and inhibitor discrimination between tissue-type plasminogen activator and urokinase.," J. Biol. Chem. 272(26):16603-16609 (1997).
Kelsey et al., "Species-and tissue-specific expression of human $\alpha_1$-antitrypsin in transgenic mice," Genes Dev. 1:161-171 (1987).
Ketner et al., "Efficient manipulation of the human adenovirus genome as an infectious yeast artificial chromosome clone," Proc. Natl. Acad. Sci. USA 91:6186-6190 (1994).
Kikić et al., "Clinicopathological relevance of granular C4d deposition in peritubular capillaries of kidney allografts," Transpl. Int. 27(3):312-321 (2014).
Klein et al., "Complement Factor H Polymorphism in Age-Related Macular Degeneration," Science 308(5720):385-389 (2005).
Kokryakov et al., "Protegrins: leukocyte antimicrobial peptides that combine features of corticostatic defensins and tachyplesins," FEBS Lett. 327(2):231-236 (1993).
Kollias et al., "Regulated expression of human $^A\gamma$-, β-, and hybrid γβ-globin genes in transgenic mice: manipulation of the developmental expression patterns," Cell 46:89-94 (1986).

Komada et al., "Effects of secretable SOD delivered by genetically modified cells on xanthine/xanthine oxidase and paraquat-induced cytotoxicity in vitro," Biol. Pharm. Bull. 22(8):846-853 (1999).
Krumlauf et al., "Developmental regulation of a-fetoprotein genes in transgenic mice," Mol. Cell. Biol. 5(7):1639-1648 (1985).
Krupers et al., "Complexation of poly(ethylene oxide) with poly(acrylic acid-co-hydroxyethyl methacrylate)s," Eur. Polym. J. 32(6):785-790 (1996).
Lappegard et al., "Differential Effect of Heparin Coating and Complement Inhibition on Artificial Surface-Induced Eicosanoid Production," Ann. Thorac. Surg. 79:917-923 (2005).
Lappegard et al., "The artificial surface-induced whole blood inflammatory reaction revealed by increases in a series of chemokines and growth factors is largely complement dependent," J. Biomed. Mater. Res. A 87(1):129-135 (2008).
Leder et al., "Consequences of widespread deregulation of the c-myc gene in transgenic mice: multiple neoplasms and normal development," Cell 45:485-495 (1986).
Leduc et al., "Activation of human furin precursor processing endoprotease occurs by an intramolecular autoproteolytic cleavage," J. Biol. Chem 267(20):14304-14308 (1992).
Lee et al., "A two-phase linear regression model for biologic half-life data," J. Lab. Clin. Med. 115(6):745-748 (1990).
Li et al., "Urokinase-type plasminogen activator-induced monocyte adhesion requires a carboxyl-terminal lysine and cAMP-dependent signal transduction," J. Biol. Chem. 270(51):30282-30285 (1995).
Li et al., "Biochemical properties of recombinant mutants of nonglycosylated single chain urokinase-type plasminogen activator," Biochim. Biophys. Acta. 1159(1):37-43 (1992).
Liang et al., "Prediction of antigenic epitopes on protein surfaces by consensus scoring," BMC Bioinformatics 10:302 (2009), 10 pages.
Lijnen et al., "Characterization of the binding of urokinase-type plasminogen activator (u-PA) to plasminogen, to plasminogen-activator inhibitor-1 and to the u-PA receptor," Eur. J. Biochem. 224(2):567-574 (1994).
Lijnen et al., "Structural and functional characterization of mutants of recombinant single-chain urokinase-type plasminogen activator obtained by site-specific mutagenesis of $Lys^{158}$, $Ile^{159}$ and $Ile^{160}$," Eur. J. Biochem. 177(3):575-582 (1988).
Lijnen et al., "Enzymatic properties of single-chain and two-chain forms of a $Lys^{158}$-→$Glu^{158}$ mutant of urokinase-type plasminogen activator," Eur. J. Biochem. 172(1):185-188 (1988).
Lijnen et al., "Biochemical properties of recombinant single-chain urokinase-type plasminogen activator mutants with deletion of Asn2 through Phe157 and/or substitution of Cys279 with Ala," Eur. J. Biochem. 205(2):701-709 (1992).
Lijnen et al., "Plasminogen activation with single-chain urokinase-type plasminogen activator (scu-PA). Studies with active site mutagenized plasminogen ($Ser^{740}$->Ala) and plasmin-resistant scu-PA ($Lys^{158}$-ΔGlu)," J. Biol. Chem. 265(9):5232-5236 (1990).
Lin et al., "Inhibition of Nuclear Translocation of Transcription Factor NF-κB by a Synthetic Peptide Containing a Cell Membrane-permeable Motif and Nuclear Localization Sequence," J. Biol. Chem. 270(24):14255-14258 (1995).
Lindenbaum et al., "A mammalian artificial chromosome engineering system (ACE System) applicable to biopharmaceutical protein production, transgenesis and gene-based cell therapy," Nucleic Acids Res. 32(21):e172 (2004), 15 pages.
Liu et al., "A site-directed mutagenesis of pro-urokinase which substantially reduces its intrinsic activity," Biochem. 35:14070-14076 (1996).
Liu et al., "Human m-ficolin is a secretory protein that activates the lectin complement pathway," J. Immunol. 175:3150-3156 (2005).
Liu et al., "Prourokinase mutant that induces highly effective clot lysis without interfering with hemostasis," Circ. Res. 90(7):757-763 (2002).
Lowy et al., "Isolation of Transforming DNA: Cloning the Hamster aprt Gene," Cell 22:817-823 (1980).
Lu, Y. and A.M. Felix, "Pegylated Peptides I: Solid-Phase Synthesis of $N^\alpha$-Pegylated Peptides Using Fmoc Strategy," Peptide Res. 6(3):140-146 (1993).

(56) References Cited

OTHER PUBLICATIONS

Lu, Y. and A.M. Felix, "Pegylated peptides II. Solid-phase synthesis of amino-, carboxy-and side-chain pegylated peptides," Int. J. Peptide Protein Res. 43:127-138 (1994).
MacDonald, R.J., "Expression of the pancreatic elastase I gene in transgenic mice," Hepatology 7(1):42S-51S (1987).
Madison et al., "Converting tissue plasminogen activator to a zymogen: a regulatory triad of Asp-His-Ser," Science 262:419-421 (1993).
Madison et al., "Restoration of serine protease-inhibitor interaction by protein engineering," J. Biol. Chem. 265(35):21423-21426 (1990).
Madison et al., "Serpin-resistant mutants of human tissue-type plasminogen activator," Nature 339:721-724 (1989).
Magdolen et al., "Systematic mutational analysis of the receptor-binding region of the human urokinase-type plasminogen activator," Eur. J. Biochem. 237(3):743-751 (1996).
Magram et al., "Developmental regulation of a cloned adult β-globin gene in transgenic mice," Nature 315:338-340 (1985).
Malhotra et al., "Collectins, collectin receptors and the lectin pathway of complement activation," Clin. Exp. Immunol. 97(Suppl 2):4-9 (1994).
Maller et al., "Variation in complement factor 3 is associated with risk of age-related macular degeneration," Nat. Genet. 39(10):1200-1201 (2007).
Malmqvist, M., "BIACORE: an affinity biosensor system for characterization of biomolecular interactions," Biochem. Soc. Trans. 27:335-340 (1999).
Malyszko et al., "Biomarkers of delayed graft function as a form of acute kidney injury in kidney transplantation," Scientific Reports 5:11684 (2015), 9 pages.
Markiewski, M.M. and J.D. Lambris, "The Role of Complement in Inflammatory Diseases From Behind the Scenes into the Spotlight," Am. J. Pathol. 171(3):715-727 (2007).
Martin et al., "A simple vector system to improve performance and utilisation of recombinant antibodies," BMC Biotechnology 6:46 (2006), 15 pages.
Mason et al., "The hypogonadal mouse: reproductive functions restored by gene therapy," Science 234:1372-1378 (1986).
McGeer, P.L. and McGeer, E.G., "The possible role of complement activation in Alzheimer disease," Trends Mol. Med. 8(11):519-523 (2002).
Mehvar, R., "Modulation of the Pharmacokinetics and Pharmacodynamics of Proteins by Polyethylene Glycol Conjugation," J. Pharm. Pharmaceut. Sci. 3(1):125-136 (2000).
Melnick et al., "Characterization of a nonglycosylated single chain urinary plasminogen activator secreted from yeast," J. Biol. Chem. 265(2):801-807 (1990).
Merrifield, R.B., "Solid Phase Peptide Synthesis. I. The Synthesis of a Tetrapeptide," J. Am. Chem. Soc. 85:2149-2154 (1963).
Miller et al., "Use of Retroviral Vectors for Gene Transfer and Expression," Methods Enzymol. 217:581-599 (1993).
Miyake et al., "Synthesis of recombinant human single-chain urokinase-type plasminogen activator variants resistant to plasmin and thrombin," J. Biochem. 104(4):643-647 (1988).
Mizuno et al., "Soluble complement receptor type 1 protects rats from lethal shock induced by anti-Crry antibody following lipopolysaccharide priming," Int. Arch. Allergy Immunol. 127(1):55-62 (2002).
Molineux, G., "Pegylation: Engineering Improved Biopharmaceuticals for Oncology," Pharmacotherapy 23(8 Pt 2):3S-8S (2003).
Mollnes et al., "Essential role of the C5a receptor in E coli-induced oxidative burst and phagocytosis revealed by a novel lepirudin-based human whole blood model of inflammation," Blood 100(5):1869-1877 (2002).
Molloy et al., "Human furin is a calcium-dependent serine endoprotease that recognizes the sequence Arg-X-X-Arg and efficiently cleaves anthrax toxin protective antigen," J. Biol. Chem. 267(23):16396-16402 (1992).
Mondino, A. and Blasi, F., "uPA and uPAR in fibrinolysis, immunity and pathology," Trends Immunol. 25(8):450-455 (2004).
Monfardini et al., "A Branched Monomethoxypoly(ethylene glycol) for Protein Modification," Bioconjugate Chem. 6(1):62-69 (1995).
Montes et al., "Functional basis of protection against age-related macular degeneration conferred by a common poly morphism in complement factor B," Proc. Nat. Acad. Sci. 106(11):4366-4371 (2009).
Morgan et al., "Complement therapeutics; history and current progress," Mol. Immunol. 40:159-170 (2003).
Moxley, G. and S. Ruddy, "Elevated plasma C3 anaphylatoxin levels in rheumatoid arthritis patients," Arthrit. Rheum. 30(10):1097-1104 (1987).
Mukhina et al., "The chemotactic action of urokinase on smooth muscle cells is dependent on its kringle domain. Characterization of interactions and contribution to chemotaxis," J. Biol. Chem. 275(22):16450-16458 (2000).
Mullins et al., "Drusen associated with aging and age-related macular degeneration contain proteins common to extracellular deposits associated with atherosclerosis, elastosis, amyloidosis, and dense deposit disease," FASEB J. 14:835-846 (2000).
Nakayama K., "Furin: a mammalian subtilisin/Kex2p-like endoprotease involved in processing of a wide variety of precursor proteins," Biochem. J. 327(Pt 3):625-635 (1997).
Needleman et al., "A general method applicable to the search for similarities in the amino acid sequence of two proteins," J. Mol. Biol. 48:443-453 (1970).
Nelles et al., "Characterization of recombinant human single chain urokinase-type plasminogen activator mutants produced by site-specific mutagenesis of lysine 158," J. Biol. Chem. 262(12):5682-5689 (1987).
Newton et al., "Angiogenin single-chain immunofusions: influence of peptide linkers and spacers between fusion protein domains," Biochemistry 35(2):545-553 (1996).
Nienaber et al., "Re-engineering of human urokinase provides a system for structure-based drug design at high resolution and reveals a novel structural subsite," J. Biol. Chem. 275(10):7239-7248 (2000).
Nilsson et al., "Compstatin Inhibits Complement and Cellular Activation in Whole Blood in Two Models of Extracorporeal Circulation," Blood 92(5):1661-1667 (1998).
Oehlke et al., "Cellular uptake of an α-helical amphipathic model peptide with the potential to deliver polar compounds into the cell interior non-endocytically," Biochim. Biophys. Acta. 1414:127-139 (1998).
Ornitz et al., "Elastase I promoter directs expression of human growth hormone and SV40 T antigen genes to pancreatic acinar cells in transgenic mice," Cold Spring Harbor Symp. Quant. Biol. 50:399-409 (1985).
Ostresh et al., "Peptide libraries: determination of relative reaction rates of protected amino acids in competitive couplings," Biopol. 34:1681-1689 (1994).
Paborsky et al., "Mammalian cell transient expression of tissue factor for the production of antigen," Protein Engineering 3(6):547-553 (1990).
Patel et al., "Ocular drug delivery systems: An overview," World J. Pharmacol. 2(2):47-64 (2013).
Paul, ed., Fundamental Immunology, 2nd ed., Raven Press, New York, pp. 332-336 (1989).
Pearson W. R. and Lipman, D. J., "Improved tools for biological sequence comparison," Proc. Natl. Acad. Sci. USA 85:2444-2448 (1988).
Peng et al., "Mutation of Arg154 to Gly154 in urokinase augments its fibrin-specificity," Biochem. Mol. Biol. Int. 41(5):887-894 (1997).
Peng et al., "High level expression of a mutant (K151E, R154G) of single chain urokinase-type plasminogen activator in silkworm," Biotechnology Letters 21(11):979-985 (1999).
Pennesi et al., "Animal models of age related macular degeneration," Mol. Aspects Med. 33(4):487-509 (2012).
Petersen et al., "Localization of epitopes for monoclonal antibodies to urokinase-type plasminogen activator. Relationship between epitope localization and effects of antibodies on molecular interactions of the enzyme," Eur. J. Biochem. 268(16):4430-4439 (2001).

(56) References Cited

OTHER PUBLICATIONS

Pham et al., "Large-scale transient transfection of serum-free suspension-growing HEK293 EBNA1 cells: peptone additives improve cell growth and transfection efficiency," Biotechnol. Bioeng. 84(3):332-342 (2003).
Piddlesden et al., "Soluble recombinant complement receptor 1 inhibits inflammation and demyclination in antibody-mediated demyclinating experimental allergic encephalomyelitis," J. Immunol. 152(11):5477-5484 (1994).
Pinkert et al., "An albumin enhancer located 10 kb upstream functions along with its promoter to direct efficient, liver-specific expression in transgenic mice," Gene Dev. 1:268-276 (1987).
Ploug, M. "Structure-Function Relationships in the Interaction Between the Urokinase-Type Plasminogen Activator and Its Receptor," Curr. Pharm. Des. 9(19):1499-1528 (2003).
Pooga et al., "Cell penetration by transportan," FASEB J. 12:67-77 (1998).
Pooga et al., "Cellular translocation of proteins by transportan," FASEB J. 15:1451-1453 (2001).
Pratt et al., "Local synthesis of complement component C3 regulates acute renal transplant rejection," Nat. Med. 8(6):582-587 (2002).
Quax et al., "Binding of human urokinase-type plasminogen activator to its receptor. Residues involved in species specificity and binding," Arterioscler. Thromb. Vasc. Biol. 18(5):693-701 (1998).
Rawlings et al., "Families of scrine peptidases," Meth. Enzymol. 244:19-61 (1994).
Readhead et al., "Expression of a myelin basic protein gene in transgenic shiverer mice: correction of the dysmyelinating phenotype, " Cell 48:703-712 (1987).
Reynolds et al., "Plasma Complement Components and Activation Fragments: Associations with Age-Related Macular Degeneration Genotypes and Phenotypes," Invest. Ophthalmol. Vis. Sci. 50(12):5818-5827 (2009).
Rhodes et al., "Transformation of Maize by Electroporation of Embryos," In: Plant Cell Electroporation and Electrofusion Protocols. Methods in Molecular Biology, vol. 55, Nickoloff, J.A., ed., Humana Press, Inc., Totowa, NJ, pp. 121-131 (1995).
Rich, R.L. and D.G. Myszka, "Advances in surface plasmon resonance biosensor analysis," Curr. Opin. Biotechnol. 11:54-61 (2000).
Richardson, J. S., "The anatomy and taxonomy of protein structure," Adv. Prot. Chem. 34:167-339 (1981).
Ricklin, D. and J.D. Lambris, "Complement-targeted therapeutics," Nat. Biotechnol. 25(11):1265-1275 (2007).
Ricklin, D. and J.D. Lambris, "Compstatin: A Complement Inhibitor on its Way to Clinical Application," Adv. Exp. Med. Biol. 632:273-292 (2008).
Rinder et al., "Blockade of C5a and C5b-9 generation inhibits leukocyte and platelet activation during extracorporeal circulation," J. Clin. Invest. 96:1564-1572 (1995).
Roberts et al., "Chemistry for peptide and protein PEGylation," Adv. Drug Deliv. Rev. 54(4):459-476 (2002).
Roscoe et al., "Human Serum Albumin and the p53-Derived Peptide Fusion Protein Promotes Cytotoxicity Irrespective of p53 Status in Cancer Cells," Mol. Pharmaceutics 15:5046-5057 (2018).
Rosenberg, R.D. and K.A. Bauer, "New Insights into Hypercoagulable States," Hosp. Prac., vol. 21, Issue 3, pp. 131-138, 143, 147 (1986).
Ruben et al., "Structural and Functional Characterization of Human Immunodeficiency Virus tat Protein," J. Virol. 63(1):1-8 (1989).
Sahu, A. and J.D. Lambris, "Structure and biology of complement protein C3, a connecting link between innate and acquired immunity," Immunological Reviews 180:35-48 (2001).
Sato, H., "Enzy matic procedure for site-specific pegylation of proteins," Adv. Drug Deliv. Rev. 54(4):487-504 (2002).
Sawhney et al., "Bioerodible Hydrogels Based on Photopolymerized Poly(ethylene glycol)-co-poly($\alpha$-hydroxy acid) Diacry late Macromers," Macromolecules 26:581-587 (1993).
Scatchard, G., "The attractions of proteins for small molecules and ions," Ann. N.Y. Acad. Sci. 51:660-672 (1949).

Scharf et al., "Heat Stress Promoters and Transcription Factors," In: Plant Promoters and Transcription Factors. Results and Problems in Cell Differentiation, Nover, L., ed., vol. 20, Springer, Berlin, Heidelberg, pp. 125-162 (1994).
Schmidt et al., "Inhibitor of complement, Compstatin, prevents polymer-mediated Mac-1 up-regulation of human neutrophils independent of biomaterial type tested," J. Biomed. Mater. Res. 66A:491-499 (2003).
Scholl et al., "Systemic Complement Activation in Age-Related Macular Degeneration," PLoS One 3(7):e2593 (2008), 7 pages.
Schwartz R.M. and M.O. Dayhoff, "Matrices for detecting distant relationships," in Atlas of Protein Sequence and Structure, National Biomedical Research Foundation, pp. 353-358 (1978).
Seidah, N.G. and M. Chrétien, "Eukaryotic protein processing: endoproteolysis of precursor proteins," Curr. Opin. Biotechnol. 8(5):602-607 (1997).
Shani, M., "Tissue-specific expression of rat myosin light-chain 2 gene in transgenic mice," Nature 314:283-286 (1985).
Skeldal et al., "Binding areas of urokinase-type plasminogen activator-plasminogen activator inhibitor-1 complex for endocytosis receptors of the low-density lipoprotein receptor family, determined by site-directed mutagenesis," FEBS J. 273:5143-5159 (2006).
Smith, T.F. and M.S. Waterman, "Comparison of biosequences," Adv. Appl. Math. 2:482-489 (1981).
Soulika et al., "Inhibition of Heparin/Protamine Complex-Induced Complement Activation by Compstatin in Baboons," Clin. Immunol. 96(3):212-221 (2000).
Stevens et al., "Effects of anti-C5a antibodies on the adult respiratory distress syndrome in septic primates," J. Clin. Invest. 77:1812-1816 (1986).
Stoppelli et al., "Differentiation-enhanced binding of the amino-terminal fragment of human urokinase plasminogen activator to a specific receptor on U937 monocytes," Proc. Natl. Acad. Sci. USA 82:4939-4943 (1985).
Stove et al., "Circulating complement proteins in patients with sepsis or systemic inflammatory response syndrome," Clin. Diagn. Lab. Immunol. 3(3):175-183 (1996).
Strassburger et al., "Adaptation of plasminogen activator sequences to known protease structures," FEBS Lett. 157(2):219-223 (1983).
Strohl, W.R., "Fusion Proteins for Half-Life Extension of Biologics as a Strategy to Make Biobetters," BioDrugs 29:215-239 (2015).
Stroud, R.M., "A family of protein-cutting proteins," Sci. Am. 231:74-88 (1974).
Sun et al., "Identification of a flexible loop region (297-313) of urokinase-type plasminogen activator, which helps determine its catalytic activity," J. Biol. Chem. 272(38):23818-23823 (1997).
Sun, Z. and J. Liu, "Mutagenesis at Pro[309] of Single-Chain Urokinase-Type Plasminogen Activator Alters Its Catalytic Properties," PROTEINS: Structure, Function, and Bioinformatics 61:870-877 (2005).
Sun et al., "Analysis of the forces which stabilize the active conformation of urokinase-type plasminogen activator," Biochemistry 37(9):2935-2940 (1998).
Swift et al., "Tissue-specific expression of the rat pancreatic elastase I gene in transgenic mice," Cell 38:639-646 (1984).
Szalai et al., "The Arthus reaction in rodents: species-specific requirement of complement," J. Immunol. 164:463-468 (2000).
Thakkinstian et al., "Systematic review and meta-analysis of the association between complementary factor H Y402H polymorphisms and age-related macular degeneration," Hum. Mol. Genet. 15(18):2784-2790 (2006).
Tjernberg et al., "Acute Antibody-Mediated Complement Activation Mediates Lysis of Pancreatic Islets Cells and May Cause Tissue Loss in Clinical Islet Transplantation," Transplantation 85:1193-1199 (2008).
Troppmann et al., "Delayed graft function in the absence of rejection has no long-term impact: A study of cadaver kidney recipients with good graft function at 1 year after transplantation," Transplantation 61(9):1331-1337 (1996).
Tsubery et al., "Prolonging the Action of Protein and Peptide Drugs by a Novel Approach of Reversible Polyethylene Glycol Modification," J. Biol. Chem. 279(37):38118-38124 (2004).
Tsuji et al., "The effects of amino-acid mutations on specific interactions between urokinase-type plasminogen activator and its

(56) References Cited

OTHER PUBLICATIONS receptor: Ab initio molecular orbital calculations," Journal of Molecular Graphics and Modelling 29:975-984 (2011).
Tsujikawa et al., "Secretion of a variant of human single-chain urokinase-type plasminogen activator without an N-glycosylation site in the methylotrophic yeast, Pichia pastoris and characterization of the secreted product, " Yeast 12(6):541-553 (1996).
Türkmen et al., "Mutational analysis of the genes encoding urokinase-type plasminogen activator (uPA) and its inhibitor PAI-1 in advanced ovarian cancer," Electrophoresis 18(5):686-689 (1997).
Ueshima et al., "Expression and characterization of clustered charge-to-alanine mutants of low $M_r$ single-chain urokinase-type plasminogen activator," Thromb. Haemost. 71(1):134-140 (1994) [Abstract only], 2 pages.
UniProt Database Accession No. A0A2R9BBQ2, "Plasminogen activator, urokinase (Pan paniscus (Pygmy chimpanzee) (Bonobo))." Published [online] on Jun. 20, 2018, 2 pages.
Ustach, C.V. and Kim, H. C., "Platelet-Derived Growth Factor D is Activated by Urokinase Plasminogen Activator in Prostate Carcinoma Cells," Mol. Cell. Biol. 25(14):6279-6288 (2005).
Veronese et al., "Branched and Linear Poly(Ethylene Glycol): Influence of the Polymer Structure on Enzymological, Pharmacokinetic, and Immunological Properties of Protein Conjugates," J. Bioactive Compatible Polymers 12:196-207 (1997).
Wagner et al., "Nucleotide sequence of the thymidine kinase gene of herpes simplex virus type 1," Proc. Natl. Acad. Sci. USA 78(3):1441-1445 (1981).
Wang et al., "Anti-C5 monoclonal antibody therapy prevents collagen-induced arthritis and ameliorates established disease," Proc. Natl. Acad. Sci. USA 92:8955-8959 (1995).
Wang et al., "Amelioration of lupus-like autoimmune disease in NZB/W $F_1$ mice after treatment with a blocking monoclonal antibody specific for complement component C5," Proc. Natl. Acad. Sci. USA 93:8563-8568 (1996).
Watson et al., "Molecular Biology of the Gene," 4th Edition, The Benjamin/Cummings Publ. Co., Inc., p. 224 (1987), 25 pages.
Weiner et al., "Liposome-collagen gel matrix: a novel sustained drug delivery system," J. Pharm. Sci. 74(9):922-925 (1985).
Wells, J. A., "Additivity of mutational effects in proteins," Biochem. 29(37):8509-8517 (1990).
Whitlow et al., "An improved linker for single-chain Fv with reduced aggregation and enhanced proteolytic stability," Protein Eng. 6(8):989-995 (1993).
Wigler et al., "Transfer of Purified Herpes Virus Thymidine Kinase Gene to Cultured Mouse Cells," Cell 11:223-232 (1977).
Wigler et al., "Transformation of mammalian cells with an amplifiable dominant-acting gene," Proc. Natl. Acad. Sci. USA 77(6):3567-3570 (1980).
Wyman et al., "Design, Synthesis, and Characterization of a Cationic Peptide That Binds to Nucleic Acids and Permeabilizes Bilayers," Biochemistry 36:3008-3017 (1997).
Yamamoto et al., "Identification of a functional promoter in the long terminal repeat of rous sarcoma virus," Cell 22:787-797 (1980).
Yang, X. and X. Yu, "An introduction to epitope prediction methods and software," Rev. Med. Virol. 19:77-96 (2009).
Yates et al., "Complement C3 Variant and the Risk of Age-Related Macular Degeneration," New Engl. J. Med. 357(6):553-561 (2007).
Yoshimoto et al., "Characterization of single chain urokinase-type plasminogen activator with a novel amino-acid substitution in the kringle structure," Biochim. Biophys. Acta. 1293:83-89 (1996).
Yu et al., "Targeting Complement Pathways During Cold Ischemia and Reperfusion Prevents Delayed Graft Function," Am. J. Transplant. 16(9):2589-2597 (2016).
Zalipsky, S., "Chemistry of polyethylene glycol conjugates with biologically active molecules," Adv. Drug Del. Rev. 16:157-182 (1995).
Zareparsi et al., "Strong Association of the Y402H Variant in Complement Factor H at 1q32 with Susceptibility to Age-Related Macular Degeneration," Am. J. Hum. Genet. 77(1):149-153 (2005).
Zaitsev et al., "Sustained thromboprophylaxis mediated by an RBC-targeted pro-urokinase zymogen activated at the site of clot formation," Blood 115(25):5241-5248 (2010).
Zeslawska et al., "Crystals of the urokinase type plasminogen activator variant βc-uPA in complex with small molecule inhibitors open the way towards structure-based drug design," J. Mol. Biol. 301(2):465-475 (2000).
Zeslawska et al., "Crystals of urokinase type plasminogen activator complexes reveal the binding mode of peptidomimetic inhibitors," J. Mol. Biol. 328(1):109-118 (2003).
Zhang et al., "Alteration in the IL-2 signal peptide affects scorction of proteins in vitro and in vivo," J. Gene Med. 7(3):354-365 (2005).
Zhao, X. and J. M. Harris, "Novel Degradable Poly(ethylene glycol) Esters for Drug Delivery," in Poly(ethylene glycol), Chemistry and Biological Applications, ACS Symposium Series, vol. 680, chapter 28, Harns, J. and S. Zalipsky, (eds.), pp. 458-472 (1997).
Zilow et al., "Complement activation and the prognostic value of C3a in patients at risk of adult respiratory distress syndrome," Clin. Exp. Immunol. 79:151-157 (1990).
International Search Report and Written Opinion, mailed May 11, 2020, in connection with International Application No. PCT/US2019/068839, 18 pages.
PCT Demand for International Preliminary Examination (Chapter II), and Response (Article 34(2)(b) PCT), filed Oct. 2, 2020, responsive to the Written Opinion of the International Searching Authority, mailed May 11, 2020, in connection with International Application No. PCT/US2019/068839, 135 pages.
International Preliminary Report on Patentability, mailed Dec. 4, 2020, in connection with International Application No. PCT/US2019/068839, 9 pages.
Office Action, issued Apr. 13, 2022, in connection with U.S. Appl. No. 16/734,256, 14 pages.
Response, filed Sep. 8, 2022, to Non-Final Office Action, issued Apr. 13, 2022, in connection with U.S. Appl. No. 16/734,256, 58 pages.
Notice of Allowance, mailed Nov. 9, 2022, in connection with U.S. Appl. No. 16/734,256, 9 pages.
Supplemental Notice of Allowability, mailed Jan. 5, 2023, in connection with U.S. Appl. No. 16/734,256, 3 pages.
Examiner's Report, issued Dec. 2, 2022, in connection with Canadian Patent Application No. 3,123,872, 10 pages.
Response, filed Apr. 3, 2023, to Examiner's Report, issued Dec. 2, 2022, in connection with Canadian Patent Application No. 3,123,872, 152 pages.
Letters Patent, issued May 5, 2022, in connection with Algerian Patent Application No. 210347 [English letter and original document in French], 3 pages.
Communication Pursuant to Rules 94(3) EPC, issued Nov. 21, 2022, in connection with European Patent Application No. 19845802.8, 4 pages.
Search Report and Written Opinion, issued Feb. 22, 2023, in connection with Singapore Patent Application No. 11202106244R, 9 pages.
Letter/Written Disclosure of the Supplemental Information Disclosure Statement for the above-referenced application, filed herewith on Mar. 8, 2024, 2 pages.
Barthel et al., "Plasminogen is a complement inhibitor," J. Biol. Chem. 287(22):18831-18842 (2012).
Cook et al., "Urokinase-type plasminogen activator and arthritis progression: role in systemic disease with immune complex involvement," Arthritis Res. Ther. 12(2):R37 (2010).
Crippa M.P., "Urokinase-type plasminogen activator," Int. J. Biochem. Cell Biol. 39(4):690-694 (2007).
Hagemeyer et al., "Construction and characterization of a recombinant plasminogen activator composed of an anti-fibrin single-chain antibody and low-molecular-weight urokinase," J. Thromb. Haemost. 2(5):797-803 (2004).
Look et al., "Pooled analysis of prognostic impact of urokinase-type plasminogen activator and its inhibitor PAI-1 in 8377 breast cancer patients," J. Natl. Cancer Inst. 94(2):116-28 (2002).
Prüfer, Kay et al. "The bonobo genome compared with the chimpanzee and human genomes," Nature 486(7404):527-531 (2012).

(56) References Cited

OTHER PUBLICATIONS

Examiner's Report, issued Oct. 19, 2023, in connection with Canadian Patent Application No. 3,123,872, 7 pages.
Response, filed Feb. 16, 2024, to Examiner's Report, issued Oct. 19, 2023, in connection with Canadian Patent Application No. 3,123,872, 119 pages.
Examiner's Report, issued Dec. 13, 2023, in connection with Canadian Patent Application No. 3,176,021, 9 pages.
Search Report and Written Opinon, issued Dec. 26, 2023, in connection with Chilean Application No. 202101710 [English translation of the Written Opinion, and original documents in Spanish], 30 pages.
Office Action, issued Dec. 1, 2023, in connection with Chinese Patent Application No. 201980093212.X [English translation of Office Action and Search Report, and original document in Chinese], 12 pages.
Office Action, issued Feb. 06. 2024, in connection with Colombian Patent Application No. NC2021/0008338 [English Translation, and Original Document in Spanish], 36 pages.
Response, filed Feb. 22, 2024, to Offical Action, issued Sep. 27, 2023, in connection with Indonesian Patent Application No. P00202105762, [English translation of the response as filed and claims as filed in English], 24 pages.
Letter/Written Disclosure of the Supplemental Information Disclosure Statement for the above-referenced application, filed herewith on Jul. 17, 2023, 2 pages.
Examiner's Report, issued Jun. 2, 2023, in connection with Canadian Patent Application No. 3,123,872, 6 pages.
Search Report and Written Opinon, issued Mar. 30, 2023, in connection with Chilean Application No. 202101710 [English reporting letter, English machine translation of the Search Report and Written Opinion, and original documents in Spanish], 40 pages.
Letter/Written Disclosure of the Supplemental Information Disclosure Statement for the above-referenced application, filed herewith on Feb. 3, 2025, 4 pages.
Office Action, issued Dec. 23, 2024, in connection with Colombian Patent Application No. NC2021/0008338 [Machine Generated English language Translation, and Original Document in Spanish], 70 pages.
Machine-generated English language translation of Korean Patent Publication No. KR 20110099421 A, generated from Google Translate, 22 pages.
Letter/Written Disclosure of the Supplemental Information Disclosure Statement for the above- referenced application, filed herewith on Mar. 21, 2025, 3 pages.
Office Action, received Feb. 26, 2025, in connection with Eurasian Patent Application No. 202100200 [Reporting email with English translation of the Office Action], 3 pages.
Office Action, issued Feb. 25, 2025, in connection with Indonesian Patent Application No. P00202105762 [English Translation of the Offical Action and original document in Indonesian], 5 pages.

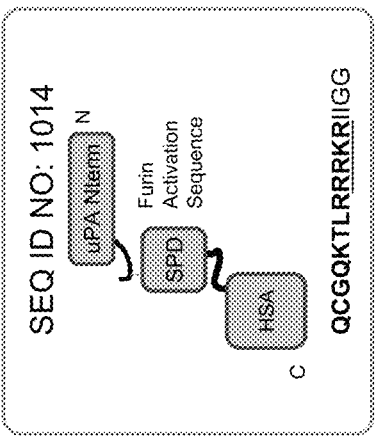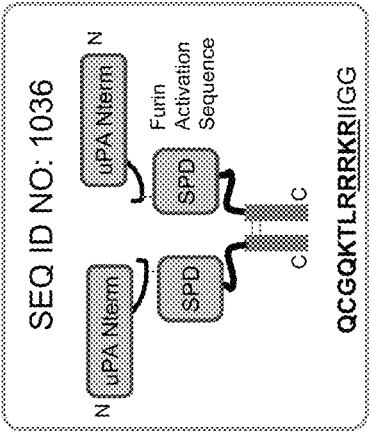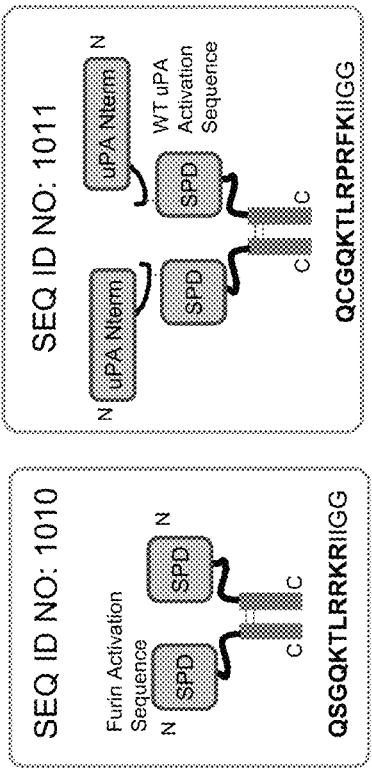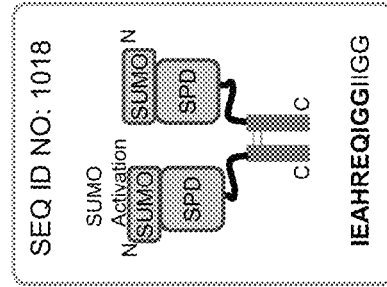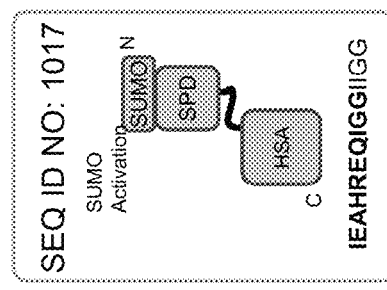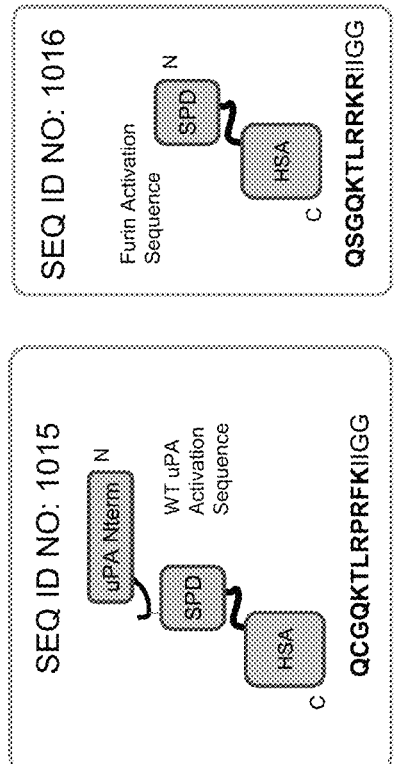

| Exemplary properties of modified u-PA polypeptides | | | | | | | | | | | | | | |
|---|---|---|---|---|---|---|---|---|---|---|---|---|---|---|
| | Mutation by Chymotrypsin Numbering | | | | | | | | | | | | C3 Activity (%) on Day 7 | |
| SEQ ID NO.*: | R35 | H37 | R37a | V38 | T39 | V41 | D60a | Y60b | T97a | L97b | H99 | C122 | Y149 | hC3 cleavage (nM) | Vitreous | PBS |
| 5 | R | H | R | V | T | V | D | Y | T | L | H | S | Y | 3380 | 102 | 111 |
| 21 | Q | Y | E | E | Y | R | P | Q | I | A | Q | S | R | 19 | 83 | 94 |
| 22 | R | Y | E | E | Y | R | P | Q | I | A | Q | S | R | 51 | 73 | 79 |
| 23 | Q | H | E | E | Y | R | P | Q | I | A | Q | S | R | 46 | 88 | 92 |
| 24 | Q | Y | R | E | Y | R | P | Q | I | A | Q | S | R | 6 | 87 | 99 |
| 25 | Q | Y | E | V | Y | R | P | Q | I | A | Q | S | R | 10 | 105 | 103 |
| 26 | Q | Y | E | E | T | R | P | Q | I | A | Q | S | R | 161 | 93 | 108 |
| 27 | Q | Y | E | E | Y | V | P | Q | I | A | Q | S | R | 519 | 88 | 100 |
| 28 | Q | Y | E | E | Y | R | D | Q | I | A | Q | S | R | 30 | 93 | 97 |
| 29 | Q | Y | E | E | Y | R | P | Y | I | A | Q | S | R | 11 | 58 | 61 |
| 30 | Q | Y | E | E | Y | R | P | Q | T | A | Q | S | R | 25 | 86 | 92 |
| 31 | Q | Y | E | E | Y | R | P | Q | I | L | Q | S | R | 155 | 90 | 111 |
| 32 | Q | Y | E | E | Y | R | P | Q | I | A | H | S | R | 92 | 89 | 108 |
| 33 | Q | Y | E | E | Y | R | P | Q | I | A | Q | S | Y | 9 | 74 | 99 |

FIG. 5

MODIFIED UROKINASE-TYPE PLASMINOGEN ACTIVATOR POLYPEPTIDES AND METHODS OF USE

RELATED APPLICATIONS

This application is a divisional of allowed U.S. patent application Ser. No. 16/734,256, entitled "MODIFIED UROKINASE-TYPE PLASMINOGEN ACTIVATOR POLYPEPTIDES AND METHODS OF USE," filed Jan. 3, 2020, which is a continuation of International Patent Application No. PCT/US2019/068839, entitled "MODIFIED UROKINASE-TYPE PLASMINOGEN ACTIVATOR POLYPEPTIDES AND METHODS OF USE," filed Dec. 27, 2019, each to inventors Edwin L. Madison, Christopher Thanos, Vanessa Soros, Mikhail Popkov, Kimberly Tipton, Matthew John Traylor, Eric Steven Furfine, and Jeffrey Charles Way, and to Applicant Vertex Pharmaceuticals Incorporated. U.S. application Ser. No. 16/734,256 and International Patent Application No. PCT/US2019/068839 each claim benefit of priority to U.S. Provisional Application Ser. No. 62/786,302, entitled "MODIFIED UROKINASE-TYPE PLASMINOGEN ACTIVATOR POLYPEPTIDES AND METHODS OF USE," filed Dec. 28, 2018, to inventors Edwin L. Madison, Christopher D. Thanos, Vanessa Soros, Mikhail Popkov, and Kimberly Tipton, and to Applicant Vertex Pharmaceuticals Incorporated.

Where permitted, the subject matter of each of these applications is incorporated by reference in its entirety.

INCORPORATION BY REFERENCE OF SEQUENCE LISTING PROVIDED ELECTRONICALLY

An electronic version of the Sequence Listing is filed herewith, the contents of which are incorporated by reference in their entirety. The electronic file was created on Feb. 6, 2023, is 1,616 kilobytes in size, and is titled 4940BSEQ001.XML.

FIELD OF THE INVENTION

Provided are modified u-PA polypeptides and fusion proteins that cleave a complement protein, thereby, inhibiting complement activation. By virtue of this inhibition the modified u-PA polypeptides and fusion proteins can be used for treatment of diseases and conditions mediated by complement or in which complement activation plays a role. These diseases and conditions, include, but are not limited to, ophthalmic indications, including macular degeneration, such as age-related macular degeneration (AMD) and Stargardt disease, renal delayed graft function (DGF), ischemic and reperfusion disorders, including myocardial infarction and stroke, sepsis, autoimmune diseases, inflammatory diseases and diseases with an inflammatory component, including Alzheimer's Disease and other neurodegenerative disorders.

BACKGROUND

The complement (C) system is part of the immune system and plays a role in eliminating invading pathogens and in initiating the inflammatory response. The complement system of humans and other mammals involves more than 30 soluble and membrane-bound proteins that participate in an orderly sequence of reactions resulting in complement activation. The blood complement system has a wide array of functions associated with a broad spectrum of host defense mechanisms including anti-microbial and anti-viral actions. Products derived from the activation of C components include the non-self-recognition molecules C3b, C4b and C5b, as well as the anaphylatoxins C3a, C4a and C5a that influence a variety of cellular immune responses. These anaphylatoxins also act as pro-inflammatory agents.

The complement system is composed of an array of enzymes and non-enzymatic proteins and receptors. Complement activation occurs by one of three primary modes known as the "classical" pathway, the "alternative" pathway and the "lectin" pathway (see FIG. 1). Complement typically is activated or triggered by 1 of these 3 pathways, which, as shown in FIG. 1, converge at C3 activation. In a fourth complement-activation mechanism, referred to as the intrinsic pathway, serine proteases associated with the coagulation/fibrinolytic cascade activate the complement system directly through cleavage of C3 or C5, independently of the classical, alternate, and lectin pathways.

These pathways can be distinguished by the process that initiates complement activation. The classical pathway is initiated by antibody-antigen complexes or aggregated forms of immunoglobulins; the alternative pathway is initiated by the recognition of structures on microbial and cell surfaces; and the lectin pathway, which is an antibody-independent pathway, is initiated by the binding of mannan binding lectin (MBL, also designated mannose binding protein) to carbohydrates such as those that are displayed on the surface of bacteria or viruses. Activation of the cascades results in production of complexes involved in proteolysis or cell lysis and peptides involved in opsonization, anaphylaxis and chemotaxis.

The complement cascade, which is a central component of an animal's immune response, is an irreversible cascade. Numerous protein cofactors regulate the process. Inappropriate regulation, typically inappropriate activation, of the process can be a facet of, or can occur in a variety of disorders that involve inappropriate inflammatory and immune responses, such as those observed in acute and chronic inflammatory diseases and other conditions involving an inappropriate immune response. These diseases and disorders include autoimmune diseases, such as rheumatoid arthritis and lupus, cardiac disorders and other inflammatory diseases, such as sepsis and ischemia-reperfusion injury.

Because of the involvement of the complement pathways in a variety of diseases and conditions, components of the complement pathways are targets for therapeutic intervention, particularly for inhibition of the pathway. Examples of such therapeutics include synthetic and natural small molecule therapeutics, antibody inhibitors, and recombinant soluble forms of membrane complement regulators. There are limitations to strategies for preparing such therapeutics. Small molecules have short half-lives in vivo and need to be continually infused to maintain complement inhibition thereby limiting their role, especially in chronic diseases. Therapeutic antibodies can result in an immune response in a subject, and thus can lead to complications in treatment, particularly treatments designed to modulate immune responses. Thus, there exists a need for therapeutics for treatment of complement-mediated diseases and diseases in which complement activation plays a role. These include acute and chronic inflammatory diseases. Accordingly, among the objectives herein, it is an objective to provide such therapeutics to target the activation of the complement cascade and to provide therapeutics and methods of treatment of diseases.

SUMMARY

Provided are modified urokinase-type plasminogen activator (u-PA) polypeptides that include insertions, deletions and/or replacements of amino acids in the protease domain that result in increased cleavage activity on the complement protein C3 compared to wild-type u-PA protease domain (where the protease domain can include the replacement of the free Cys with Ser to reduce/eliminate aggregation). The modified u-PA polypeptides and fusion proteins are any that comprise the protease domain, such as full length activated protease, zymogen forms thereof, and fusion proteins the contain a modified u-PA polypeptide and a fusion partner that confers pharmacological property or activity. The modified u-PA polypeptides and fusion proteins containing the modified u-PA polypeptides, when in active form, inhibit complement activation. In particular these polypeptides and fusion proteins cleave C3 whereby C3 activity is inhibited or eliminated.

Modifications, including amino acid deletions, replacements and insertions, provided herein are in the protease domain. The modified u-PA polypeptides (and fusion proteins) include or are the protease domains. The modified u-PA polypeptides further can include post-translational and other modifications to other than the primary amino acid sequence, such as conjugation or linkage to other polypeptides and moieties that alter properties, such as serum half-life, and resistance to endogenous protease. Such modifications include, but are not limited to, linkage to albumin, linkage to multimerization domain(s), and PEGylation. Thus, modified u-PA polypeptides can be modified by PEGylation, albumination, farnesylation, carboxylation, hydroxylation, phosphorylation, and other polypeptide modifications known in the art. Among the modifications is the replacement of a free cysteine, in the zymogen, such as C122, by chymotrypsin numbering, with serine or alanine, to reduce aggregation, particularly upon expression in vitro. This replacement is optional, and not necessarily included in polypeptides that to be pegylated or expressed in vivo.

The modified u-PA polypeptides and fusion proteins inactivate complement protein C3 by cleavage, thereby reducing, inhibiting or preventing complement activation. The modified u-PA polypeptides (and fusion proteins) cleave C3 to thereby inhibit complement activation. They cleave C3 at a site, such as in the active site of C3, that inactivates or inhibits C3 activity to thereby inhibit complement activation. The modified u-PA polypeptides provided herein were selected and designed to cleave within QHARASHLG, and in particular where P1-P1' is RA (QHAR↓ASHL; see SEQ ID NO:47 residues 737-744, where cleavage is between residues 740 and 741). As a result, these modified u-PA polypeptides can be used as therapeutics for treating disorders, diseases and/or conditions in which complement activation plays a role such that inhibition thereof can treat the disorders, diseases and/or conditions. The modified u-PA polypeptides also can have reduced activity for a native substrate, such as plasminogen, compared to a wild-type u-PA or compared to one that just has the replacement corresponding to C122S, by chymotrypsin numbering.

Among the diseases and conditions for which the modified u-PA polypeptides and fusion proteins are used for treatment are any C3-mediated or complement mediated or involved disease and conditions. These include ophthalmic disorders, such as age-related macular degeneration (AMD) and diabetic retinopathies, and organ rejection, such as renal Delayed Graft Function (DGF) as well as other diseases, disorders and conditions that can be treated by inhibiting complement activation. AMD is treated by administration to the vitreous humor, such as by intravitreal injection or intraretinal or subretinal injection, and DGF is treated by intravenous or other systemic administration. The modified u-PA polypeptides and fusion proteins further can be modified, such as by PEGylation, to enhance or improve or impart desirable pharmacological properties, including increased half-life and/or decreased immunogenicity. Other diseases and conditions include, for example, Rheumatoid arthritis (RA), ocular diseases, membranoproliferative glomerulonephritis (MPGN), Multiple Sclerosis (MS), Myasthenia gravis (MG), asthma, inflammatory bowel disease, immune complex (IC)-mediated acute inflammatory tissue injury, Alzheimer's Disease (AD), Ischemia-reperfusion injury, atypical hemolytic uremic syndrome (aHUS), and Complement 3 Glomerulopathy (C3G).

The unmodified u-PA polypeptides include precursor forms, mature forms, the catalytic domain, and catalytically active forms thereof, and also fusion proteins, such as those described in Examples 14-16. Exemplary of the unmodified u-PA polypeptides are those whose sequences are set forth in SEQ ID NOs:1-6. Included among the unmodified u-PA polypeptides are those in which the free cysteine in the catalytic domain (corresponding to C122 by chymotrypsin numbering) is replaced by another amino acid, such as S or A, particularly S, which does not alter catalytic activity, but decreases aggregation of the polypeptides. It is understood that all modified u-PA polypeptides can include a replacement, generally S, at the residue corresponding to C122 by chymotrypsin numbering.

Among the modified urokinase-type plasminogen activator (u-PA) polypeptides provided herein are those that contain one or more amino acid modifications selected from among replacements corresponding to R35Q, H37Y, V41R, V41L, Y40Q, D60aP, L97bA, T97aI, and H99Q, and conservative amino acid modifications therefor, whereby the modified u-PA polypeptide has increased activity/specificity for a complement protein compared to the unmodified active form of the u-PA polypeptide, where: the amino acid modifications are selected from among replacements, insertions and deletions; corresponding residues can be determined by alignment with the mature form of u-PA; the modified u-PA polypeptide cleaves a complement protein to thereby inhibit or reduce complement activation compared to the unmodified u-PA polypeptide that does not contain the amino acid modifications; residues are numbered by chymotrypsin numbering; the unmodified u-PA polypeptide comprises the sequence set forth in any of SEQ ID NOs:1-6 (wild-type human full-length u-PA, wild-type protease (catalytic) domain u-PA, wild-type mature u-PA, full-length u-PA with the replacement corresponding to C122S, protease domain u-PA with the replacement corresponding to C122S, and mature u-PA with the replacement corresponding to C122S) and catalytically active fragment thereof that includes the amino acid replacement(s). The conservative modifications are selected from among R35Y, W, F or N; H37 R, Q, E, W or F, V41K, D60aS, T97aD, L or V, L97bG or S and H99N, by chymotrypsin numbering.

In particular, among these modified urokinase-type plasminogen activator (uPA) polypeptides are those containing one or more amino acid modifications selected from among replacements corresponding to R35Q, H37Y, V41R, V41L, Y40Q, D60aP, L97bA, T97aI, and H99Q.

The modified u-PA polypeptides have reduced activity and/or specificity for cleavage of a substrate sequence in plasminogen. The complement protein for which the polypeptides have increased specificity/activity is C3; cleavage inactivates C3. Exemplary of cleavage sites is within the active site of C3. Among the modified u-PA polypeptides are those that have increased activity for cleavage of C3 that is least 3-fold greater than the unmodified u-PA polypeptide of SEQ ID NO:5 (protease domain with the C122S replacement).

The modified u-PA polypeptides include those that contain the replacement H37Y, such as the replacements H37Y/V38E. The modified u-PA polypeptides include those that contain the replacements R35Y/H37K or R35Q/H37K, such as those that comprise the replacements R35Y/H37K/V38E or R35Q/H37K/V38E.

Also provided are the modified u-PA polypeptides, including those described above, that also contain the replacement L97bA and/or R35Q, and or H99Q, and/or D60aP, and/or T97aI.

The modified u-PA polypeptide can further include the amino acid replacement corresponding to T39Y, T39W, T39F, such as T39Y, or conservative replacements selected from T39M or T39L. Others of the modified u-PA polypeptides include or further include the amino acid replacements R35Q/H37Y and/or V38E/V41R/Y149R.

Others of the modified u-PA polypeptides are those that comprise the modification V41R, such as modified u-PA polypeptides comprising the modifications V38E/V41R, including those that further comprise a replacement at one or more of positions R35, H37 and V38. These include modified u-PA polypeptide in which the replacement at V38 is E, such as for example, modified u-PA polypeptides comprising R35Y/H37S/V38E/V41R, H37Y/V38E, and other combinations of residues that contribute to cleavage of C3 and/or stability, such as in a body fluid.

Among the modified u-PA polypeptides provided herein are that have an $ED_{50}$ for inactivation cleavage of C3 of less than or 100 nM, or 50 nM or 30 nM or 25 nM in an in vitro assay. Exemplary of these are those set forth in Table 14, where the $ED_{50}$ is 100 nM or less, or those set forth in Table 14, where the $ED_{50}$ is less than 50 nM, or those set forth in Table 14, where the $ED_{50}$ is less than 30 nM, or those set forth in Table 14, where the $ED_{50}$ less than 25 nM. Exemplar of an assay to assess $ED_{50}$ is one that comprises incubation of the substrate complement protein human C3 with various concentrations of each modified protease for 1 hour at 37° C. to determine the $ED_{50}$. In particular, the modified u-PA polypeptides are any that cleave C3 with an $ED_{50}$ of 50 nM or less.

The unmodified u-PA polypeptides can consist of the sequence of amino acids set forth in any of SEQ ID NOs:1-6 or can include additional modifications, including additional insertions, and deletions. Any of the replacements, insertions or deletions herein can be included in the unmodified u-PA polypeptides, such as the protease domain, particularly the protease domain of SEQ ID NO:5. The modified u-PA polypeptide can have at least 85%, 90%, 91%, 92%, 93%, 94%, 95%, 96%, 97%, 98%, 99% or more sequence identity with the polypeptides of any of SEQ ID NOs:1-6 or a catalytically active portion thereof. The modified u-PA polypeptides can contain 1 or up to 2, 3, 4, 5, 6, 7, 8, 9, 10, 11, 12, 13, 14, 15, 16, or 17 amino acid replacements, insertions or deletions, compared to the unmodified u-PA polypeptide of any of SEQ ID NOs:1-6 or a catalytically active portion thereof.

Hence, provided are modified u-PA polypeptides that contain the modification V41R, or H37Y, or L97bA, or R35Q, or H99Q, or D60aP, or T97aI or combinations thereof. Any of the modified u-PA polypeptides can further contain the amino acid replacement corresponding to T39Y, T39W, T39F or conservative replacements thereof selected from T39M or T39L. In particular, the modified u-PA polypeptides can further contain the amino acid replacement T39Y, such as the combination T39Y/V41R, and up to 12 or 13 additional modifications as well as the optional C122S. Any of the modified u-PA polypeptides further can contain the amino acid replacement V38E, and can further contain one or more of the amino acid modifications R35Q, Y60bQ and/or Y149R. Any of the modified u-PA polypeptides can further contain the amino acid modification R37aE or R37aS. Hence, modified u-PA polypeptides provided herein can contain the replacements R35Q/H37Y/T39Y/V41R or R35Q/H37Y/T39Y/V41R/C122S. Any of the modified u-PA polypeptides can contain the replacement corresponding to H99Q.

Among the modified u-PA polypeptides provided herein are those that contain the amino acid modifications R35Q/H37Y/T39Y/V41R/L97bA/H99Q/C122S or R35Q/H37Y/T39Y/V41R/L97bA/H99Q, or T39Y/V41R/Y60bQ/L97bA/H99Q or T39Y/V41R/Y60bQ/L97bA/H99Q/C122S or T39Y/V41R/D60aP/L97bA/H99Q/C122S or T39Y/V41R/D60aP/L97bA/H99Q/C122S. Also among the modified u-PA polypeptides provided herein are those that contain the amino acid modifications corresponding to Y40Q/V41L/L97bA/C122S or Y40Q/V41R/L97bA/C122S or Y40Q/V41L/L97bA or Y40Q/V41R/L97bA or R37aS/V41R/L97bG/H99Q or R37aS/V41R/L97bG/H99Q/C122S or T39Y/V41L/L97bA/C122S or T39Y/V41R/L97bA/H99Q/C122S.

Included among the modified u-PA polypeptides are those that contain the modifications: R35Q/H37Y/R37aE/V38E/T39Y/V41R/D60aP/Y60bQ/T97aI/L97bA/H99Q/C122S/Y149R or R35Q/H37Y/R37aE/V38E/T39Y/V41R/D60aP/Y60bQ/T97aI/L97bA/H99Q/Y149R.

Provided are modified u-PA polypeptides that contain the amino acid modifications, included are polypeptides with the modifications: H37Y/R37aE/V38E/T39Y/V41R/D60aP/Y60bQ/T97aI/L97bA/H99Q/C122S/Y149R; or R35Q/R37aE/V38E/T39Y/V41R/D60aP/Y60bQ/T97aI/L97bA/H99Q/C122S/Y149R; or R35Q/H37Y/V38E/T39Y/V41R/D60aP/Y60bQ/T97aI/L97bA/H99Q/C122S/Y149R; or R35Q/H37Y/R37aE/T39Y/V41R/D60aP/Y60bQ/T97aI/L97bA/H99Q/C122S/Y149R; or R35Q/H37Y/R37aE/V38E/V41R/D60aP/Y60bQ/T97aI/L97bA/H99Q/C122S/Y149R; or R35Q/H37Y/R37aE/V38E/T39Y/D60aP/Y60bQ/T97aI/L97bA/H99Q/C122S/Y149R; or R35Q/H37Y/R37aE/V38E/T39Y/V41R/Y60bQ/T97aI/L97bA/H99Q/C122S/Y149R; or R35Q/H37Y/R37aE/V38E/T39Y/V41R/D60aP/T97aI/L97bA/H99Q/C122S/Y149R; or R35Q/H37Y/R37aE/V38E/T39Y/V41R/D60aP/Y60bQ/L97bA/H99Q/C122S/Y149R; or R35Q/H37Y/R37aE/V38E/T39Y/V41R/D60aP/Y60bQ/T97aI/H99Q/C122S/Y149R; or R35Q/H37Y/R37aE/V38E/T39Y/V41R/D60aP/Y60bQ/T97aI/L97bA/C122S/Y149R; or R35Q/H37Y/R37aE/V38E/T39Y/V41R/D60aP/Y60bQ/T97aI/L97bA/H99Q/C122S or R35Q/H37Y/R37aE/V38E/T39Y/V41R/D60aA/Y60bP/T97aI/L97bA/H99Q/C122S/Y149R or R35L/H37D/R37aS/V38E/T39Y/V41R/D60aP/Y60bD/T97aI/L97bA/H99Q/C122S/Y149R or R35M/H37G/R37aD/V38E/T39W/V41R/D60aP/Y60bD/T97aI/L97bA/H99Q/C122S/Y149R or R35Q/H37G/R37aP/V38E/T39Y/V41R/D60aP/Y60bE/T97aI/L97bA/H99Q/C122S/Y149R or R35A/H37G/R37aE/V38E/T39F/V41R/D60aE/Y60bP/T97aI/L97bA/H99Q/C122S/Y149R or R35Q/H37S/R37aE/V38E/T39Y/V41R/D60aP/Y60bS/T97aI/L97bA/H99Q/C122S/Y149R or R35Q/H37T/R37aP/V38E/T39Y/V41R/D60aE/Y60bD/T97aI/L97bA/H99Q/C122S/Y149R or R35Q/H37G/R37aE/V38E/T39H/V41R/D60aP/Y60bA/ T97aI/L97bA/H99Q/C122S/Y149R or R35W/H37D/ R37aS/V38E/T39Y/V41R/D60aE/Y60bS/T97aI/L97bA/ H99Q/C122S/Y149R or R35Q/H37G/R37aE/V38E/T39Y/ V41R/D60aP/Y60bT/T97aI/L97bA/H99Q/C122S/Y149R or R35W/H37P/R37aN/V38E/T39Y/V41R/D60aP/Y60bL/ D97T/T97aE/L97bG/A98S/H99L/C1 22S or R35W/H37P/ R37aN/V38E/T39Y/V41K/D60aP/Y60bD/T97aI/L97bA/H99Q/C122S/Y151L/Q192A or R35Y/H37V/R37aW/V38E/T39Y/V41R/D60aP/Y60bE/T97aI/L97bA/H99Q/C122S/Y151L/Q192T or R35W/H37P/R37aN/V38E/T39Y/V41K/D60aP/Y60bD/T97aI/L97bA/H99Q/C122S/Y151L/Q192T or each with no replacement at C122. Exemplary of these modified u-PA polypeptides are those that contain the modifications R35Q/H37Y/R37aE/V38E/T39Y/V41R/D60aP/Y60bQ/T97aI/L97bA/H99Q/C122S/Y149R.

Exemplary of these polypeptides are those whose sequences are set forth in any of SEQ ID NOs:8-44 and 987, such as 21 and 39-44 as well as precursor and full-length modified u-PA polypeptides that contain the polypeptides whose sequences are set forth in SEQ ID NOs:8-44 and catalytically active portions thereof. It also is understood that in any of the modified u-PA polypeptides provided herein the Cys at residue 122, by chymotrypsin numbering, can be substituted with Ser, or can remain Cys. The Cys is retained for embodiments in which the polypeptide, including fusion proteins, containing the modified u-PA protease domain is intended for use as a two chain form in which the free C122 forms a disulfide bond with another free Cys in the polypeptide, or the Cys is modified, such as by PEGylation. In all embodiments described herein, position 122 can be Cys or Ser. The skilled person can select the appropriate residue depending upon the intended use.

The unmodified u-PA polypeptide comprises the protease domain of any of SEQ ID NOs: 1-6, or a catalytically active portion thereof, including or containing only the protease domain of SEQ ID NO:2 or SEQ ID NO:5.

The modified u-PA polypeptide can contain additional modifications, including post-translational modifications, modifications that introduce or remove a glycosylation site, modification, such as linkage or conjugation to a polymer, such as a PEG to increase serum half-life and/or to reduce immunogenicity or both. In particular, any and all of the modified u-PA polypeptides described and provided herein can be PEGylated. Fusion proteins containing the modified u-PA polypeptides provided herein, such as fusion with an Fc domain, or a targeting agent specific for a targeted cell or antigen also are provided.

Among the modified u-PA polypeptides and fusion proteins provided herein are those that have stability of greater than 50% or 80% after incubation in PBS, or in a body fluid, such as aqueous humor or serum for 7 days. Also among the modified u-PA polypeptides are those that, when in active form, have at least 100-fold decreased activity on plasmin compared to a corresponding form of unmodified u-PA polypeptide.

Also among the modified u-PA polypeptides and fusion proteins provided herein are those that have an $ED_{50}$ for inactivation cleavage of C3 of less than or 100 nM, or 50 nM or 30 nM or 25 nM or 15 nM or 10 nM in an in vitro assay, such as any exemplified in the Examples herein. These include polypeptides that contain or are the protease domains set forth in Table 14, which lists numerous mutation strings and the $ED_{50}$ for modified u-PA polypeptide protease domains that exhibit the $ED_{50}$ assessed as described in Example 2. Modified u-PA polypeptides and fusion polypeptides that have an $ED_{50}$ of 100 nM or less, less than 50 nM, less than 30 nM, less than 25 nM, less than 15 nM, and less than 10 nM, are among those that can be used as protease domains, or in longer u-PA forms and/or in fusion proteins as described herein.

Provided are conjugated proteins, including fusion proteins containing a modified u-PA polypeptide or a catalytically active portion of any of the modified u-PA polypeptides fused to a non-protease polypeptide or a portion thereof. Non-protease polypeptides such as those that include a multimerization domain, such as an Fc domain, a polypeptide, such as albumin, that increases serum stability, or a protein transduction domain (PTD) are provided.

As discussed above, all of the modifications can be in the unmodified polypeptides whose sequences are set forth in any of SEQ ID NOs:1-6 and catalytically active portions thereof. Included among the polypeptides are those in which the unmodified polypeptide has the sequence set forth in SEQ ID NO:5 (the protease domain with the C122S replacement).

Also provided are fusion proteins that contain the modified u-PA polypeptides provided herein and additional polypeptides, such as serum albumin, multimerization domains, signal sequences and other trafficking sequences and tags to facilitate expression and isolation. The fusion proteins also can include activation sequences to activate the u-PA portions. Active forms of the fusion proteins are produced upon expression, and removal of signal sequences, and any other processing and trafficking signals to result in active fusion proteins that cleave C3. The active forms of the fusion proteins include 2 chain activated forms and also dimers, such as those resulting from inclusion of a multimerization domain.

Among the fusion proteins are those that contain a modified u-PA polypeptide or a catalytically active portion of a modified u-PA polypeptide, such as those in Table 14, that is fused to a non-protease polypeptide or a portion thereof. The fusion proteins also can include activation sequences, and, before processing, signal sequences and other trafficking signals. Non protease polypeptides, include, but are not limited to, any known to those of skill in the art to confer a desirable pharmaceutical activity or property, a multimerization domain, such as an $F_c$, a protein transduction domain (PTD), a hyaluronic acid binding domain (HABD), an antibody to target to a particular antigen. The fusion proteins also can include activation sequences, such as a native u-PA activation sequence or a furin activation sequence. Exemplary of furin activation sequences are those that are or comprise QSGQKTLRRRKR (SEQ ID NO:996) or QCGQKTLRRRKR (SEQ ID NO:995) or QSGQKTLRRKR (SEQ ID NO: 1044) or a furin activation sequence having at least 98% sequence identity thereto.

For example, fusion proteins that comprise any of the modified u-PA polypeptides as described or provided herein, and also include, prior to processing or activation, a signal sequence and the modified u-PA polypeptide or catalytically active portion thereof. Signal sequences to encode for secretion of the fusion proteins include, for example, a signal sequence from Il-2, u-PA, or IgGκ.

The fusion proteins can include a fusion partner, such as a multimerization domain, or a polypeptide that increases serum half-life, or one that confers another desirable pharmacological property or activity. Exemplary of these are an albumin, or an Fc domain, or a single chain antibody or other antigen binding fragment of an antibody, or a hyaluronic acid binding domain (HABD). Exemplary fusion partners include, but are not limited to, Tumor Necrosis factor- Stimulated Gene-6 (TSG-6); HSA, IgG Fc, an antibody or antigen binding fragment thereof, such as an anti-type II collagen antibody scFv fragment or an anti-VEGFR antibody or fragment thereof.

The fusion proteins also can include an activation sequence so that the resulting fusion protein containing u-PA is in an active form, such as a two chain form. Activation sequences can contain or be modified to contain a cysteine, which can form a disulfide bond with a free Cys, such as C122, in the modified u-PA polypeptide, whereby, upon activation, the resulting activated polypeptide comprises two chains. Exemplary activation sequences are a u-PA activation sequence and a furin activation sequence, and modified forms thereof, such an activation sequence that has the sequence set forth in any of SEQ ID NOs:995-998, 1041, and 1044 or a sequence having at least 98% or 99% sequence identity thereto.

Exemplary fusion proteins are those that contain an activation sequence, a modified u-PA polypeptide, and HSA, such as any comprising the sequence of amino acids set forth in any of SEQ ID NOs: 1014, 1015, 1016, 1019 and 1040 or a modified form thereof having at least 95%, 96%, 97%, 98%, 99% sequence identity (and containing the modifications in the sequence of the u-PA portion). For use in methods of treatment, the fusion proteins generally do not contain the signal sequence. For use in gene therapy methods, the nucleic acid can encode the signal sequence.

Provided are such fusion proteins, such as those containing the sequence of amino acids set forth in any of SEQ ID Nos: 1004-1019 and 1034-1040 or any having at least 95%, 96%, 97%, 98%, 99% sequence identity (and containing the modifications in the sequence of the u-PA portion). Exemplary of fusion proteins are those having the sequence of amino acids set forth in SEQ ID NO:1015 or 1019. In particular, the signal sequence is removed prior to use or upon expression in vivo or when produced in vitro. These include those that are in two-chain activated form containing an A chain and a B chain. For example, fusion proteins, where the B chain starts at residues IIGG of the modified u-PA polypeptide and ends at the C-terminus of the fusion protein, such as those containing a modified u-PA polypeptide and HSA, those containing the sequence of amino acids set forth in any of SEQ ID NOs:1005, 1011, 1014, 1015, and 1036, but lacking the signal sequence. Exemplary of fusion proteins in activated form is a fusion protein that contains an A chain of residues 21-178, and a B chain of residues 179- to the C-terminus of the protein with a disulfide linkage between residues 168-299. It is understood that these also include fusion proteins having at least 95%, 96%, 97%, 98%, 99% sequence identity (and containing the modifications in the sequence of the u-PA portion). For example, provided is a fusion protein containing an A chain and a B chain, where the A chain consists of residues 21-178 of SEQ ID NO:1015, and B chain consists of residues 179-1022; and the A and B chains are linked via a disulfide bridge between C168 and C299 of SEQ ID NO:1015.

Other fusion proteins provided herein contain multimerization domains such that, upon processing, they form multimers, such as dimers that form via interaction of complementary multimerization domains, such as Fc domains.

Also provided are combinations, which can be packaged as a kit, that contain a first composition containing a modified u-PA polypeptide, including, as in all embodiments, fusion proteins, particularly those in activated form, or plurality thereof, and a second composition containing a second agent or agents for treating a complement-mediated disease or disorder. The second agent or agents, for example, can be an anti-inflammatory agent(s) or anticoagulant(s). Exemplary of such agents are an anti-inflammatory agent(s) selected from among any one or more of a nonsteroidal anti-inflammatory drug (NSAID), antimetabolite, corticosteroid, analgesic, cytotoxic agent, pro-inflammatory cytokine inhibitor, anti-inflammatory cytokines, B cell targeting agents, compounds targeting T antigens, adhesion molecule blockers, chemokine receptor antagonists, kinase inhibitors, PPAR-γ (gamma) ligands, complement inhibitors, heparin, warfarin, acenocoumarol, phenindione, EDTA, citrate, oxalate, argatroban, lepirudin, bivalirudin, and ximelagatran.

Provided are nucleic acid molecules that encode any of the modified u-PA polypeptides and fusion proteins provided herein. Also provided are vectors containing such nucleic acid molecules and encoding the modified u-PA polypeptides. Vectors include prokaryotic vectors, and eukaryotic vectors, including mammalian and insect vectors, such as a baculovirus vector, yeast vectors, such as *Pichia* and *Saccharomyces*, and viral vectors, such as a herpes virus simplex vector, or a vaccinia virus vector, an AAV vector, an adenoviral vector or a retroviral vector. The vectors can be expression vectors for production of the modified u-PA polypeptides and/or vectors, such as adenoviruses and AAV viruses, particularly those with tropism for the tissue of interest, such as liver or the eye, for gene therapy.

Provided are methods of producing the modified u-PA polypeptides by growing a cell containing a vector or nucleic acid encoding a modified u-PA polypeptide or fusion protein under conditions in which the vector is expressed, and, optionally, isolating or recovering the expressed modified u-PA polypeptide.

Also provided are isolated cells and cell cultures that contain the nucleic acid molecules or the vectors. The cells can be non-human cells, or human cell cultures, but do not include any zygotes or cells that develop into a human. Cells include mammalian cells and bacterial cells, including, but not limited to, bacterial cells, such as *E. coli*, CHO, Balb/ 3T3, HeLa, MT2, mouse NS0, BHK, insect cells, yeast cells and other cells routinely used for recombinant expression of polypeptides. Methods for producing the modified u-PA polypeptide include growing the cells under conditions whereby the encoded modified u-PA polypeptide is expressed and optionally isolating or purifying the modified u-PA polypeptide. Generally, the modified u-PA polypeptides and conjugates thereof, such as fusion proteins, are produced in cells that glycosylate the proteins. The isolated modified u-PA polypeptides can be further modified, such as by PEGylation.

Also provided are pharmaceutical compositions containing the modified u-PA polypeptides and fusion proteins and/or the nucleic acids and/or the vectors. Provided are uses of the pharmaceutical compositions, nucleic acids or modified u-PA polypeptides for inhibiting complement activation to thereby treat a disease or disorder mediated by complement activation or in which complement activation plays a role in the etiology or underlying etiology of the disease or disorder. In particular, provided are uses of the nucleic acid molecules and/or vectors for gene therapy for treating such diseases, disorders and conditions, mediated by or involving complement activation, where inhibition of complement activation effects treatment or amelioration of the disease or condition. Also provided are methods of treating a disease or condition mediated by or involving complement activation by administering the vectors or administering the nucleic acid molecules. In particular, the diseases, disorders and conditions are those in which inactivation of C3 to thereby inhibit or reduce complement activation effects treatment.

Complement mediated diseases, disorders or conditions or diseases, disorders and conditions in which complement activation plays a role in the etiology or underlying etiology, include, but are not limited to, any inflammatory disorder, sepsis, rheumatoid arthritis (RA), ocular or ophthalmic disease, cardiovascular disorders, membranoproliferative glomerulonephritis (MPGN), Multiple Sclerosis (MS), Myasthenia gravis (MG), asthma, inflammatory bowel disease, immune complex (IC)-mediated acute inflammatory tissue injury, Alzheimer's Disease (AD), ischemia-reperfusion injury, atypical hemolytic uremic syndrome (aHUS), Complement 3 Glomerulopathy (C3G), and organ transplant rejection, particularly delayed organ transplant rejection. Particular diseases and disorders include ocular or ophthalmic disorders, such as a macular degeneration or a diabetic retinopathy, or inflammation due to a transplanted organ. Included among the diseases, disorders and conditions are age-related macular degeneration (AMD) and delayed renal graft function (DGF).

Methods of inhibiting complement activation are provided. The methods are effected by contacting a modified u-PA polypeptide with complement protein C3, whereby complement protein C3 is cleaved such that complement activation is reduced or inhibited. Contacting can be effected in vitro, but generally is in vivo, by administering the modified u-PA polypeptide to a subject in whom complement inactivation or reduction is desired. Administration can be systemic, such as parenterally, including intravenously, or locally, such as by contacting an affected tissue, such as the eye. Administration to the eye includes by drops, by linking the modified u-PA polypeptide to a protein transduction domain, or by intravitreal injection, intraretinal, or subretinal injection, or other such method. For diseases and conditions, such as DGF, administration can be effected by intravenous administration. Other methods include subcutaneous and transdermal administration.

The methods and uses include treatment of any disease, disorder or condition where inhibition of complement activation leads to a reduction of inflammatory symptoms associated with a complement-mediated disease or disorder selected from among an inflammatory disorder, a neurodegenerative disorder, an ophthalmic disorder and a cardiovascular disorder. These include, but are not limited to, inflammatory diseases, conditions and disorders, sepsis, rheumatoid arthritis (RA), ocular disorders, membranoproliferative glomerulonephritis (MPGN), multiple sclerosis (MS), myasthenia gravis (MG), asthma, inflammatory bowel disease, immune complex (IC)-mediated acute inflammatory tissue injury, atypical hemolytic uremic syndrome (aHUS), complement 3 glomerulopathy (C3G), Alzheimer's Disease (AD), ophthalmic disorders, such as AMD and diabetic retinopathies, and ischemia-reperfusion injury. The ischemia-reperfusion injury can involve or be caused by an event or treatment selected from among myocardial infarct (MI), stroke, angioplasty, coronary artery bypass graft, cardiopulmonary bypass (CPB), and hemodialysis or a treatment of a subject. The treatment with the modified u-PA polypeptide is effected prior to treatment of a subject. Treatments include organ transplantation. The disease, disorder or condition include ophthalmic conditions or is an ocular disease or is rejection or inflammation due to a transplanted organ, such as a diabetic retinopathy or a macular degeneration. In particular, methods of treatment of age-related macular degeneration (AMD) are provided, as are methods of treatment of delayed renal graft function (DGF). Treatment can be effected intravenously or subcutaneously or locally, such as by injection of the modified u-PA polypeptide into the eye. Included is intravitreal or intraretinal, subretinal, injection or linking the modified u-PA polypeptide to a protein transduction domain to facilitate transduction into the vitreous humor. The modified u-PA polypeptide can be linked to or conjugated to moieties that effect targeting of the polypeptide to a particular organ or tissue, or that increase serum half-life or reduce immunogenicity, such as PEGylation and/or linkage to an Fc domain or to an antibody or antigen-binding portion thereof.

Hence, provided are methods for treating a subject with a complement-mediated disorder or condition or one in which complement activation plays a role in such disorder or condition, by administering a modified u-PA polypeptide provided herein. Such uses of the modified u-PA polypeptides and fusion proteins provided herein also are provided. The modified u-PA polypeptides and fusion proteins effect treatment or can be used for such treatment because they cleave complement protein C3 to thereby inhibit or reduce complement activation. Inhibition of complement activation leads to a reduction of inflammatory symptoms associated with a complement-mediated disorder, disease or condition that involves an inflammatory response, leading to a reduction of inflammatory symptoms associated with a complement-mediated disease, condition or disorder selected from among an inflammatory disorder, a neurodegenerative disorder and a cardiovascular disorder. These include ophthalmic conditions, such as diabetic retinopathy and macular degeneration, and also delayed organ rejection, such as DGF.

Dosages for the uses and methods and single dosage formulations are provided herein. A single dosage can be empirically determined by the skilled medical practitioner, and includes, for example, single dosages that are in the range from 0.1 mg to 1 mg for local administration, and 0.1 mg to 10, 15, 20, 30 mg or more for systemic, such as intravenous administration. The particular dosage depends upon the particular disorder or disease or condition, the subject treated, the stage of the disease, the disorder or condition, the route of administration, the regimen and other such parameters. Dosages can be repeated daily, every two, three, four, five, six, or seven days, at least bi-weekly, at least every two weeks, three weeks, four weeks or longer intervals. The particular regimen and dosage depend, for example, upon the disorder treated, the mode of administration, and particulars, such as weight, of the subject. Determination thereof is within the skill of the skilled medical practitioner.

Also provided are the methods, uses and combinations and modified u-PA polypeptides and fusion proteins, where the modified u-PA polypeptide comprises the modification V41R or V41L, particularly V41R, such as V41I or R and V38E, and those containing H37Y/V38E. Exemplary of such modified u-PA polypeptide are modified u-PA polypeptides that contain the modifications Y40Q/V41R/L97bA or Y40Q/V41L/L97BA or R37aS/V41R/L97bG/H99Q, or R35Q/H37Y/R37aE/V38E/T39Y/V41R/D60aP/Y60bQ/T97aI/L97bA/H99Q/Y149R. The modifications are in any unmodified u-PA polypeptide, including those set forth in any of SEQ ID NOs:1-6, and catalytically active portions thereof that include the residue corresponding to V41. Exemplary of such modified u-PA polypeptides are the modified u-PA polypeptides that comprise the sequence of amino acid residues set forth in in SEQ ID NO: 21 or 987 or in any of SEQ ID NOs:40-44, or 40-44 without the modification at C122, by chymotrypsin numbering, and catalytically active portions thereof, and modified forms thereof, such as PEGylated forms, and fusion proteins and modified forms thereof.

Also provided are methods of treating disorders, such as DGF, by intravenously administering a modified u-PA polypeptide or fusion protein (in activated form) as described and provided herein, including the modified u-PA polypeptides that comprises the sequence of amino acid residues set forth in any of SEQ ID NOs:21 and 40-44, and modified forms thereof, such as PEGylated forms. A single dosage can be empirically determined by the skilled medical practitioner, and includes single dosages that are in the range from 0.1 mg to 1 mg. The dosage depends upon the subject, the severity or stage of the disease or disorder, such as DGF. Treatment can be repeated a plurality of times, such as two, three or four times a day, once a day, repeated every 1 day, 2 days, 3 days, 4 days, 5 days, 6 days, weekly, bi-monthly or monthly. The modified u-PA polypeptide can be one that comprises the replacements/insertions, by chymotrypsin numbering, R35Q/H37Y/R37aE/V38E/T39Y/V41R/D60aP/Y60bQ/T97aI/L97bA/H99Q/C122S/Y149R; and by mature numbering R20Q/H22Y/R23E/V27E/T28Y/V30R/D50P/Y51Q/T91I/L92A/H94Q/C121S/Y148R. Exemplary thereof is the modified u-PA polypeptide that contains the protease domain set forth in SEQ ID NO:21 or a catalytically active portion thereof, or the full-length or precursor forms that contain the protease domain, and modified forms thereof, such as PEGylated forms and fusion proteins. Administration can be effected by any suitable method, including intravenous, subcutaneous, transdermal, local, intramuscular, oral, and other systemic administration routes. Generally the administered form of the modified u-PA polypeptides provided herein is an activated form, which generally, depending upon the components of the protein (see, e.g., Example 15), is a two chain form.

The methods as described herein as described above and below, include methods of treating an ophthalmic disorder or ocular disorder by administering any of the modified u-PA polypeptides, and modified forms thereof, such as PEGylated forms and fusion proteins, such as those containing a protein transduction domain, provided herein to the eye. Ophthalmic disorders, diseases or conditions, involving complement activation include diabetic retinopathies and macular degeneration, such as AMD. The dosage is as described above, and includes single dosages of 0.1 mg to 1 mg. Modified u-PA polypeptides include those that contain the replacements R35Q/H37Y/R37aE/V38E/T39Y/V41R/D60aP/Y60bQ/T97aI/L97bA/H99Q/C122S/Y149R or R35Q/H37Y/R37aE/V38E/T39Y/V41R/D60aP/Y60bQ/T97aI/L97bA/H99Q/Y149R, Y40Q/V41L/L97bA/C122S or Y40Q/V41R/L97bA/C122S or Y40Q/V41L/L97bA or Y40Q/V41R/L97bA, and those that contain the sequence of amino acid residues set forth in any of SEQ ID NOs:21 and 40-44 and catalytically active portions thereof, as well as modified forms thereof. Treatment can be repeated a plurality of times, such as once a day. Uses of the modified u-PA polypeptides and modified forms thereof for treating AMD or DGF are provided. The modified u-PA polypeptides include any described herein, including those that contain the replacements R35Q/H37Y/R37aE/V38E/T39Y/V41R/D60aP/Y60bQ/T97aI/L97bA/H99Q/C122S/Y149R or R35Q/H37Y/R37aE/V38E/T39Y/V41R/D60aP/Y60bQ/T97aI/L97bA/H99Q/Y149R or Y40Q/V41L/L97bA/C122S or Y40Q/V41R/L97bA/C122S or Y40Q/V41L/L97bA or Y40Q/V41R/L97bA, and modified forms thereof that are PEGylated or that are fusion proteins as described herein.

Also provided are combinations containing any of the modified u-PA polypeptides or fusion protein comprising the modified u-PA polypeptides or nucleic acid, including vectors, encoding the modified u-PA polypeptides or fusion proteins; and a second agent or agents for treating a complement-mediated disease or disorder. For example, the second agent or agents can be an anti-inflammatory agent(s) or anticoagulant(s), such as, but not limited to, an anti-inflammatory agent(s) selected from among any one or more of a nonsteroidal anti-inflammatory drug (NSAID), antimetabolite, corticosteroid, analgesic, cytotoxic agent, pro-inflammatory cytokine inhibitor, anti-inflammatory cytokine, B cell targeting agent, compound targeting T antigens, adhesion molecule blocker, chemokine receptor antagonist, kinase inhibitor, PPAR-γ (gamma) ligand, complement inhibitor, heparin, warfarin, acenocoumarol, phenindione, EDTA, citrate, oxalate, argatroban, lepirudin, bivalirudin, and ximelagatran.

Methods of treatment or prevention (reduction of the risk) of a complement mediated disease or disorder by administering the modified u-PA polypeptide, fusion protein, or nucleic acid, pharmaceutical compositions, or combinations, using the polypeptides, fusion proteins and nucleic acids for treatment or prevention are provided.

Exemplary of the modified u-PA polypeptides for the combinations, pharmaceutical compositions, methods, and uses are those that comprise the modification(s) V41R or V41L, or those that comprise the modifications V38E/V41R, or the modifications Y40Q/V41R/L97bA or Y40Q/V41L/L97bA or R37aS/V41R/L97bG/H99Q, or the modifications: R35Q/H37Y/R37aE/V38E/T39Y/V41R/D60aP/Y60bQ/T97aI/L97bA/H99Q/Y149R, and optionally C122S. The unmodified u-PA polypeptide can be the unmodified u-PA polypeptide comprises the sequence of amino acid residues set forth in SEQ ID NO:2 or SEQ ID NO:5, SEQ ID NO:3, or SEQ ID NO:6.

Provided are modified u-PA polypeptides and fusion proteins that comprise the sequence of amino acid residues set forth in SEQ ID NO: 21 or 987 or in any of SEQ ID Nos: 40-44, or 40-44, including those without the modification at C122, by chymotrypsin numbering, and nucleic acids encoding modified u-PA polypeptides and fusion proteins that have these sequences, and polypeptides and proteins that have at least 95% sequence identity thereto.

The methods of treatment include methods of treating delayed graft function (DGF), atypical hemolytic uremic syndrome (aHUS), Complement 3 Glomerulopathy (C3G), and age-related macular degeneration (AMD). Dosage depends upon the particular disorder. Administration can be systemic or local, such as, for treatment of ophthalmic disorders, intravitreal or subretinal. Dosage for ophthalmic diseases and disorders, can be, for example, 0.1 to 3 mg, or 0.1 to 2 mg, or 1 to 3 mg, or 1 to 10 mg. Treatment can be repeated a plurality of times, such as at least every 2 days, 3 days, 4 days, 5 days, 6 days, weekly, bi-monthly, monthly, every two months, every three months, or every four months, every 6 months, or longer intervals. The modified u-PA polypeptides and fusion proteins and nucleic acids include any described or provided or suggested herein that cleave C3. These include modified u-PA polypeptides, and fusion proteins that comprise or encode the modifications R35Q/H37Y/R37aE/V38E/T39Y/V41R/D60aP/Y60bQ/T97aI/L97bA/H99Q/Y149R, or R35Q/H37Y/R37aE/V38E/T39Y/V41R/D60aP/Y60bQ/T97aI/L97bA/H99Q/C122S/Y149R, such as any that comprise or encode the protease domain set forth in SEQ ID NO:21 or 987 or a catalytically active portion thereof.

Methods of making or producing the modified u-PA polypeptides or fusions proteins are provided. The methods are effected by culturing cells, such as mammalian cells and cell cultures (not including human zygotes) under conditions, whereby the encoded polypeptide or fusion protein is expressed, and optionally isolating the polypeptide or fusion protein. The polypeptide or fusion protein as isolated generally does not include a signal protein or other trafficking signal, which is removed by the cell. The modified u-PA polypeptide or fusion protein can be in activated two chain form, or can be further treated to produce a two chain activated form. Alternatively, the fusion protein can be one that contains a multimerization domain so that the fusion protein is a multimer, such as a dimer.

BRIEF DESCRIPTION OF THE FIGURES

FIG. 2A is a schematic of N-terminal u-PA fusion proteins which contain the fusion partner (i.e., Fc) N-terminal to the u-PA catalytic domain. An exemplary N-terminal fusion protein is set forth in SEQ ID NO:1004, which contains human immunoglobulin light chain kappa (κ) signal sequence, Fc (Fusion partner), AGS (linker), the u-PA activation sequence, and a modified u-PA catalytic domain. FIG. 2B is a schematic of N-terminal wild-type protein which does not contain a fusion partner. An exemplary N-terminal wild-type protein is set forth in SEQ ID NO: 1005, which contains human immunoglobulin light chain kappa (κ) signal sequence, the N-terminus of u-PA, u-PA activation sequence, and a modified u-PA catalytic domain.

FIG. 3A is a schematic of C-terminal u-PA fusion proteins which contain the fusion partner C-terminal to the u-PA catalytic domain where the fusion protein lacks an activation sequence N-terminal to the u-PA catalytic domain. An exemplary C-terminal fusion protein is set forth in SEQ ID NO:1006, which contains a human IL2 Signal sequence (hIL2SP), a modified u-PA catalytic domain, a linker, and Fc (Fusion partner). Another exemplary C-terminal fusion protein is set forth in SEQ ID NO:1007, which contains a human IL2 Signal sequence (hIL2SP), a modified u-PA catalytic domain, a linker, and HSA (human serum albumin as a fusion partner). Another exemplary C-terminal fusion protein is set forth in SEQ ID NO:1008, which contains a human IL2 Signal sequence (hIL2SP), a modified u-PA catalytic domain, a linker, and a scFv that binds Collagen II (C2scFv) (Fusion partner). Another exemplary C-terminal fusion protein is set forth in SEQ ID NO:1009, which contains a human IL2 Signal sequence (hIL2SP), a modified u-PA catalytic domain, a linker, and a HABD (hyaluronic acid binding domain (Fusion partner). Another exemplary C-terminal fusion protein is set forth in SEQ ID NO:1012, which contains a human IL2 Signal sequence (hIL2SP), the wild-type u-PA catalytic domain, a linker, and Fc (Fusion partner). Another exemplary C-terminal fusion protein is set forth in SEQ ID NO:1013, which contains a human IL2 Signal sequence (hIL2SP), the wild-type u-PA catalytic domain, a linker, and HSA (Fusion partner). FIG. 3B is a schematic of C-terminal u-PA fusion proteins which contain the fusion partner (i.e., Fc or HSA) C-terminal to the u-PA catalytic domain. An exemplary C-terminal fusion protein is set forth in SEQ ID NO:1010, which contains a human immunoglobulin light chain kappa (κ) signal sequence, a furin activation sequence, a modified u-PA catalytic domain, a linker, and Fc (Fusion partner). Another exemplary C-terminal fusion protein is set forth in SEQ ID NO:1016, which contains a human immunoglobulin light chain kappa (κ) signal sequence, a furin activation sequence, a modified u-PA catalytic domain, a linker, and HSA (Fusion partner). FIG. 3C is a schematic of u-PA fusion proteins which contain a fusion partner (i.e., Fc or HSA) C-terminal to the u-PA catalytic domain and a fusion partner (i.e., the wild-type N-terminus of u-PA) N-terminal to the u-PA catalytic domain. An exemplary fusion protein is set forth in SEQ ID NO:1011, which contains a human immunoglobulin light chain kappa (κ) signal sequence, the u-PA N-terminal domain, a modified u-PA catalytic domain, a linker, and Fc (Fusion partner). Another exemplary C-terminal fusion protein is set forth in SEQ ID NO:1014, which contains a human immunoglobulin light chain kappa (κ) signal sequence, the N-terminal region of u-PA, a furin activation sequence, a modified u-PA catalytic domain, a linker, and HSA (Fusion partner). Another exemplary C-terminal fusion protein is set forth in SEQ ID NO:1015, which contains a human immunoglobulin light chain kappa (κ) signal sequence, the N-terminal region of u-PA, the u-PA activation sequence, a modified u-PA catalytic domain, a linker, and HSA (Fusion partner).

FIGS. 4A-4H are schematics of the activated forms of the fusion proteins, where SPD refers to the Serine protease domain (the modified u-PA polypeptide protease domains provided herein; the u-PA N-terminus refers generally to residues 1-178 of u-PA or any modified forms thereof. FIG. 4A is a schematic of the fusion protein of SEQ ID NO: 1010, which contains an Fc domain at the C-terminus of the u-PA protease domain (SEQ ID NO: 21) and a furin activation sequence, where disulfide linkage between the Fc domains to form a dimer. FIG. 4B is a schematic of the fusion protein of SEQ ID NO: 1011, which contains an Fc domain at the C-terminus of the u-PA protease domain (SEQ ID NO: 987), and the N-terminus of u-PA and the u-PA activation sequence at the N-terminus of the protein, where disulfide linkage between the Fc domains to form a dimer. FIG. 4C is a schematic of the fusion protein set forth in SEQ ID NO: 1036, which contains an Fc domain at the C-terminus of the u-PA protease domain (SEQ ID NO: 987), and the N-terminus of u-PA and a furin activation sequence at the N-terminus of the fusion protein, where disulfide linkage between the Fc domains form a dimer. FIG. 4D is a schematic of the fusion protein set forth in SEQ ID NO: 1014, which contains HSA at the C-terminus of the u-PA protease domain (SEQ ID NO: 987), and the N-terminus of u-PA and a furin activation sequence at the N-terminus of the fusion protein. FIG. 4E is a schematic of the fusion protein set forth in SEQ ID NO: 1015, which contains HSA at the C-terminus of the u-PA protease domain (SEQ ID NO: 987), and the N-terminus of u-PA and the u-PA activation sequence at the N-terminus of the fusion protein. FIG. 4F is a schematic of the fusion protein set forth in SEQ ID NO: 1016, which contains HSA at the C-terminus of the u-PA protease domain (SEQ ID NO: 21) and a furin activation sequence N-terminal to the protease domain. FIG. 4G is a schematic of the fusion protein set forth in SEQ ID NO: 1017, which contains HSA at the C-terminus of the u-PA protease domain (SEQ ID NO: 21) and a SUMO activation sequence N-terminal to the protease domain. FIG. 4H is a schematic of the fusion protein set forth in SEQ ID NO: 1018, which contains an Fc domain at the C-terminus of the u-PA protease domain (SEQ ID NO: 21) and the N-terminus of u-PA and a SUMO activation sequence N-terminal to the protease domain, where a disulfide linkage between the Fc domains form a dimer.

FIG. 5 provides a table of exemplary u-PA protease domain mutants and their respective activity against C3. Modified u-PA polypeptides contain each of the modifications R35Q, H37Y, R37aE, V38E, T39T, V41R, D60bP, Y60bQ, T97aI, L97bA, H99Q, C122S, and Y149R except for one modification whose activity against C3 is assessed. Cells with thin borders indicate that the modified u-PA polypeptides are mutated at this residue when compared to the reference u-PA polypeptide set forth in SEQ ID NO: 5. Cells with thick borders indicate that the modified u-PA polypeptides contain the same amino acid as the reference u-PA polypeptide set forth in SEQ ID NO: 5.

DETAILED DESCRIPTION

Figure 1:
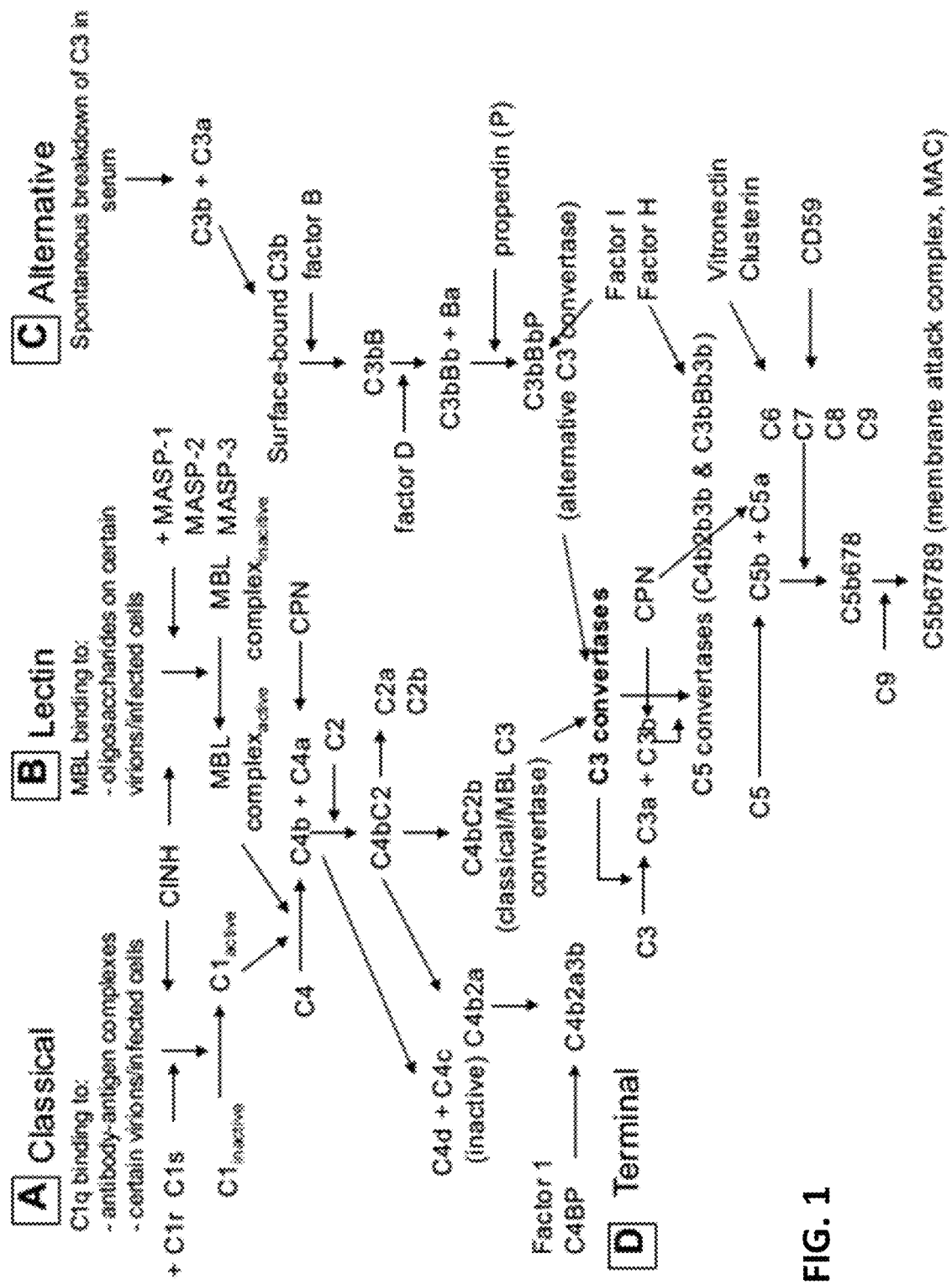
FIG. 1 depicts an overview of the classical, lectin, and alternative complement pathways and the activation of the terminal complement complex, the membrane attack complex (MAC). The figure depicts many of the more than 30 proteins that participate in the complement cascade, their action within the cascade, and where applicable, their points of convergence among the complement pathways. For example, the three pathways converge upon the generation of a C3 convertase, which cleaves C3 to form a C5 convertase yielding the formation of the MAC complex. The figure also depicts the generation of many of the complement cleavage products.

Outline
A. DEFINITIONS
B. u-PA STRUCTURE AND FUNCTION
  1. Serine proteases
  2. Structure
  3. Function/activity
C. COMPLEMENT INHIBITION BY TARGETING C3
  1. Complement Protein C3 and its Role in Initiating Complement
    a. Classical Pathway
    b. Alternative Pathway
    c. Lectin Pathway
    d. Complement-mediated effector functions
      i. Complement-mediated lysis: Membrane Attack Complex
      ii. Inflammation
      iii. Chemotaxis
      iv. Opsonization
      v. Activation of the Humoral Immune Response
  2. C3 Structure and Function
    a. C3a
    b. C3b
    c. Inhibitors of C3b
D. MODIFIED U-PA POLYPEPTIDES THAT CLEAVE C3
  1. Exemplary modified u-PA polypeptides
  2. Additional Modifications
    a. Decreased immunogenicity
    b. Fc domain
    c. Conjugation to polymers
    d. Protein transduction domain
E. ASSAYS TO ASSESS OR MONITOR u-PA ACTIVITY ON COMPLEMENT-MEDIATED FUNCTIONS
  1. Methods for assessing effects of u-PA on complement protein C3 activity
    a. Protein Detection
      i. SDS-PAGE analysis
      ii. Enzyme Immunoassay
      iii. Radial Immunodiffusion (RID)
    b. Hemolytic assays
    c. Methods for determining cleavage sites
  2. Methods for assessing wild type u-PA activity
    a. Cleavage of plasminogen
    b. Plasminogen Activation Assays
    c. u-PA-uPAR Binding Assays
    d. C3 cleavage
  ACC-AGR+ELISA
  Assessing specificity using peptide libraries
  3. Specificity
  4. Disease Models
F. METHODS OF PRODUCING NUCLEIC ACIDS ENCODING MODIFIED U-PA POLYPEPTIDES THEREOF
  1. Isolation or Preparation of Nucleic Acids Encoding u-PA Polypeptides
  2. Generation of Mutant or Modified Nucleic Acids and Encoding Polypeptides
  3. Vectors and Cells
  4. Expression
    a. Prokaryotic Cells
    b. Yeast Cells
    c. Insects and Insect Cells
    d. Mammalian Expression
    e. Plants
  5. Purification
  6. Additional Modifications
    a. PEGylation
    b. Fusion Proteins and other conjugates
  7. Nucleic acid molecules
G. COMPOSITIONS, FORMULATIONS AND DOSAGES
  1. Administration of modified u-PA polypeptides
  2. Administration of nucleic acids encoding modified u-PA polypeptides (gene therapy)
H. THERAPEUTIC USES AND METHODS OF TREATMENT
  1. Disease mediated by Complement activation
    a. Rheumatoid Arthritis
    b. Sepsis
    c. Multiple Sclerosis
    d. Alzheimer's Disease
    e. Ischemia-Reperfusion Injury
    f. Ocular disorders
    Age-Related Macular Degeneration (AMD)
    g. Organ transplantation and Delayed Graft Function (DGF)
  2. Therapeutic Uses
    a. Immune-mediated Inflammatory Disease
    b. Neurodegenerative Disease
    c. Cardiovascular Disease
    d. Age-Related Macular Degeneration (AMD)
    e. Organ transplant
      Delayed Graft Function (DGF)
  3. Combination Therapies
I. EXAMPLES

A. DEFINITIONS

Unless defined otherwise, all technical and scientific terms used herein have the same meaning as is commonly understood by one of skill in the art to which the invention(s) belong. All patents, patent applications, published applications and publications, GENBANK sequences, websites and other published materials referred to throughout the entire disclosure herein, unless noted otherwise, are incorporated by reference in their entirety. In the event that there is a plurality of definitions for terms herein, those in this section prevail. Where reference is made to a URL or other such identifier or address, it is understood that such identifiers can change and particular information on the internet can come and go, but equivalent information is known and can be readily accessed, such as by searching the internet and/or appropriate databases. Reference thereto evidences the availability and public dissemination of such information.

As used herein, cleavage refers to the breaking of peptide bonds by a protease. The cleavage site motif for a protease involves residues N- and C-terminal to the scissile bond (the unprimed and primed sides, respectively, with the cleavage site for a protease defined as . . . P3-P2-P1-P1'-P2'-P3' . . . , and cleavage occurs between the P1 and P1' residues). In human C3, cleavage by a C3 convertase occurs between residues R and S (see residues 746-751 of SEQ ID NO: 47, cleavage between residues 748 and 749 in human C3) of C3:

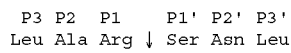

```
P3  P2  P1    P1' P2' P3'
Leu Ala Arg ↓ Ser Asn Leu
```

Typically, cleavage of a substrate in a biochemical pathway is an activating cleavage or an inhibitory cleavage. An activating cleavage refers to cleavage of a polypeptide from an inactive form to an active form. This includes, for example, cleavage of a zymogen to an active enzyme. An activating cleavage also is cleavage whereby a protein is cleaved into one or more proteins that themselves have activity. For example, the complement system is an irreversible cascade of proteolytic cleavage events whose termination results in the formation of multiple effector molecules that stimulate inflammation, facilitate antigen phagocytosis, and lyse some cells directly. Thus, cleavage of C3 by a C3 convertase into C3a and C3b is an activation cleavage. In contrast, the modified u-PA polypeptides provided herein effect inhibitory cleavage of C3, such as by cleavage in the active site.

As used herein, an inhibitory cleavage or inactivation cleavage is cleavage of a protein into one or more degradation products that are not functional. Inhibitory cleavage results in the diminishment or reduction of an activity of a protein. Typically, a reduction of an activity of a protein reduces the pathway or process for which the protein is involved. In one example, the cleavage of any one or more complement proteins that is an inhibitory cleavage results in the concomitant reduction or inhibition of any one or more of the classical, lectin, or alternative functional pathways of complement. To be inhibitory, the cleavage reduces activity by at least or at least about 1%, 2%, 5%, 10%, 20%, 30%, 40%, 50%, 60%, 70%, 80%, 90%, 95%, 99% or more compared to a native form of the protein. The percent cleavage of a protein that is required for the cleavage to be inhibitory varies among proteins but can be determined by assaying for an activity of the protein.

As used herein, "complement activation" refers to the activation of complement pathways, for example complement activation refers to an increase in the functions or activities of any one or more of the complement pathways by a protease or an increase in the activity of any of the proteins in the complement pathway. Complement activation can lead to complement-mediated cell lysis or can lead to cell or tissue destruction. Inappropriate complement activation on host tissue plays an important role in the pathology of many autoimmune and inflammatory diseases, and also is responsible for or associated with many disease states associated with bioincompatibility. It is understood that activation can mean an increase in existing activity as well as the induction of a new activity. A complement activation can occur in vitro or in vivo. Exemplary functions of complement that can be assayed and that are described herein include hemolytic assays, and assays to measure any one or more of the complement effector molecules such as by SDS PAGE followed by Western Blot or Coomassie Brilliant Blue staining or by ELISA. In some embodiments, complement activation is inhibited by a protease, such as a protease described herein, by 40%, 50%, 60%, 70%, 80%, 85%, 90%, 95% or 99% or more compared to the activity of complement in the absence of a protease.

As used herein, "inhibiting complement activation" or "complement inactivation" refers to the reduction or decrease of a complement-mediated function or activity of any one or more of the complement pathways by a protease or in the activity of any of the proteins in a pathway. A function or activity of complement can occur in vitro or in vivo. Exemplary functions of complement that can be assayed and that are described herein include hemolytic assays, and assays to measure any one or more of the complement effector molecules such as by SDS PAGE followed by Western Blot or Coomassie Brilliant Blue staining or by ELISA. A protease can inhibit complement activation by 1%, 5%, 10%, 20%, 30%, 40%, 50%, 60%, 70%, 80%, 90% or more. In other embodiments, complement activation is inhibited by a protease by 40%, 50%, 60%, 70%, 80%, 85%, 90%, 95% or 99% or more compared to the activity of complement in the absence of a protease.

As used herein, a "complement protein" or a "complement component" is a protein of the complement system that functions in the host's defense against infections and in the inflammatory process. Complement proteins include those that function in the classical pathway, those that function in the alternative pathway, and those that function in the lectin pathway. Among the complement proteins are proteases that participate in the complement pathways.

As used herein, complement proteins include any of the "cleavage products" (also referred to as "fragments") that are formed upon activation of the complement cascade. Also included among complement proteins are inactive or altered forms of complement proteins, such as iC3b and C3a-desArg. Thus, complement proteins include, but are not limited to: C1q, C1r, C1s, C2, C3, C3a, C3b, C3c, C3dg, C3g, C3d, C3f, iC3, C3a-desArg, C4, C4a, C4b, iC4, C4a-desArg, C5, C5a, C5a-des-Arg, C6, C7, C8, C9, MASP-1, MASP-2, MBL, Factor B, Factor D, Factor H, Factor I, CR1, CR2, CR3, CR4, properdin, C1Inh, C4 bp, MCP, DAF, CD59 (MIRL), clusterin and HRF and allelic and species variants of any complement protein.

As used herein, a "native" form of a complement protein is one which can be isolated from an organism such as a vertebrate in the absence of complement activation, and which has not been intentionally modified by man in the laboratory. Examples of native complement proteins include C1q, C1r, C1s, C2, C3, C4, Factor B, Factor D, properdin, C5, C6, C7, C6, and C9.

Generally, "native complement proteins" are inactive and acquire activity upon activation. Activation can require activation cleavage, maturation cleavage and/or complex formation with other proteins. An exception to this is Factor I and Factor D which have enzymatic activity in their native form. In some examples, activation of a native complement protein occurs following cleavage of the protein. For example, complement zymogens such as C3 are proteases which are themselves activated by protease cleavage such that cleavage of C3 by the C3 convertase C4b2b generates the active fragments C3a and C3b. In another example, cleavage of an inactive native complement protein results in changes in the structural stability of a protein resulting in activation of the protein. For example, C3 contains an internal thioester bond which in the native protein is stable, but can become highly reactive and activated following conformational changes that result from cleavage of the protein. Thus, the cleavage products of C3 is biologically active. Activation of C3 also can occur spontaneously in the absence of cleavage. It is the spontaneous conversion of the thioester bond in native C3 that is an initiating event of the alternative pathway of complement. In other example, activation of a native complement protein occurs following the release of a complexed regulatory molecule that inhibits the activity of an otherwise active native complement protein. For example, C1inh binds to and inactivates C1s and C1r, unless they are in complex with C1q.

As used herein, "maturation cleavage" is a general term that refers to any cleavage required for activation of a zymogen. This includes cleavage that leads to a conformational change resulting in activity (i.e. activation cleavage). It also includes cleavage in which a critical binding site is exposed or a steric hindrance is exposed or an inhibitory segment is removed or moved.

As used herein, "altered form" of a complement protein refers to a complement protein that is present in a non-native form resulting from modifications in its molecular structure. For example, C3 reaction of the thioester with water can occur in the absence of convertase cleavage, giving a hydrolyzed inactive form of C3 termed iC3. In another example, anaphylatoxins including C3a, C5a, and C4a can be desarginated by carboxypeptidase N into more stable, less active forms.

As used herein, a "fragment" or "cleavage product" of a complement protein is a region or segment of a complement protein that contains a portion of the polypeptide sequence of a native complement protein. A fragment of a complement protein usually results following the activation of a complement cascade. Generally, a fragment results from the proteolytic cleavage of a native complement protein. For example, complement protein C3 is enzymatically cleaved by a C3 convertase, resulting in two fragments: C3a which constitutes the N-terminal portion of C3; and C3b which constitutes the C-terminal portion and contains the serine protease site. A fragment of a complement protein also results from the proteolytic cleavage of another fragment of a complement protein. For example, C3b, a fragment generated from the cleavage of C3, is cleaved by Factor I to generate the fragments iC3b and C3f. Generally cleavage products of complement proteins are biologically active products and function as cleavage effector molecules of the complement system. Hence a fragment or portion of complement protein includes cleavage products of complement proteins and also portions of the proteins that retain or exhibit at least one activity of a complement protein.

As used herein, "cleavage effector molecules" or "cleavage effector proteins" refers to the active cleavage products generated as a result of the triggered-enzyme cascade of the complement system. A cleavage effector molecule, a fragment or a cleavage product resulting from complement activation can contribute to any of one or more of the complement-mediated functions or activities, which include opsonization, anaphylaxis, cell lysis and inflammation. Examples of cleavage or effector molecules include, but are not limited to, C3a, C3b, C4a, C4b, C5a, C5b-9, and Bb. Cleavage effector molecules of the complement system, by virtue of participation in the cascade, exhibit activities that include stimulating inflammation, facilitating antigen phagocytosis, and lysing some cells directly. Complement cleavage products promote or participate in the activation of the complement pathways.

As used herein, "anaphylatoxins" are cleavage effector proteins that trigger degranulation of, or release of substances from, mast cells or basophils, which participate in the inflammatory response, particularly as part of defense against parasites. If the degranulation is too strong, it can cause allergic reactions. Anaphylatoxins include, for example, C3a, C4a and C5a. Anaphylatoxins also indirectly mediate spasms of smooth muscle cells (such as bronchospasms), increases in permeability of blood capillaries, and chemotaxis.

As used herein, "chemotaxis" refers to receptor-mediated movement of leukocytes towards a chemoattractant typically in the direction of the increasing concentration thereof, such as in the direction of increasing concentration of an anaphylatoxin.

As used herein, "opsonization" refers to the alteration of the surface of a pathogen or other particle so that it can be ingested by phagocytes. A protein that binds or alters the surface of a pathogen is termed an opsonin. Antibody and complement proteins opsonize extracellular bacteria for uptake and destruction by phagocytes such as neutrophils and macrophages.

As used herein, "cell lysis" refers to the breaking open of a cell by the destruction of its wall or membrane. Hemolysis of red blood cells is a measure of cell lysis.

As used herein, "complement protein C3" or "C3" refers to complement protein C3 of the complement system that functions in the host defense against infections and in the inflammatory process. Human complement protein C3 is a 1663 amino acid single-chain pre-proprotein or zymogen set forth in SEQ ID NO:47 that that contains a 22 amino acid signal peptide (amino acids 1-22 of SEQ ID NO:47) and a tetra-arginine sequence (amino acids 678-671 of SEQ ID NO:47) that is removed by a furin-like enzyme resulting in a mature two chain protein containing a beta chain (amino acids 23-667 of SEQ ID NO:47) and an alpha chain (amino acids 672-1663 of SEQ ID NO:47) linked by a disulfide bond between residues C559 and C816. Complement protein C3 is further activated by proteolytic cleavage by a C3 convertase (C4b2b or C3bBb) between amino acids 748 and 749 of SEQ ID NO:47 generating the anaphylatoxin C3a and the opsonin C3b.

As used herein, a "zymogen" refers to a protein that is activated by proteolytic cleavage, including maturation cleavage, such as activation cleavage, and/or complex formation with other protein(s) and/or cofactor(s). A zymogen is an inactive precursor of a protein. Such precursors are generally larger, although not necessarily larger, than the active form. With reference to u-PA or complement protein C3, zymogens are converted to active enzymes by specific cleavage, including catalytic and autocatalytic cleavage, or by binding of an activating co-factor, which generates an active enzyme. A zymogen, thus, is an enzymatically inactive protein that is converted to a proteolytic enzyme by the action of an activator. Cleavage can be effected autocatalytically. A number of complement proteins are zymogens; they are inactive, but become cleaved and activated upon the initiation of the complement system following infection. Zymogens, generally, are inactive and can be converted to mature active polypeptides by catalytic or autocatalytic cleavage of the proregion from the zymogen.

As used herein, a "proregion," "propeptide," or "pro sequence," refers to a region or a segment of a protein that is cleaved to produce a mature protein. This can include segments that function to suppress enzymatic activity by masking the catalytic machinery and thus preventing formation of the catalytic intermediate (i.e., by sterically occluding the substrate binding site). A proregion is a sequence of amino acids positioned at the amino terminus of a mature biologically active polypeptide and can be as little as a few amino acids or can be a multidomain structure.

As used herein, an "activation sequence" refers to a sequence of amino acids in a zymogen that is the site required for activation cleavage or maturation cleavage to form an active protease. Cleavage of an activation sequence can be catalyzed autocatalytically or by activating partners. Activation cleavage is a type of maturation cleavage in which a conformational change required for activity occurs. This is a classical activation pathway, for example, for serine proteases in which a cleavage generates a new N-terminus which interacts with the conserved regions of catalytic machinery, such as catalytic residues, to induce conformational changes required for activity. Activation can result in production of multi-chain forms of the proteases. In some instances, single chain forms of the protease can exhibit proteolytic activity.

As used herein, "domain" refers to a portion of a molecule, such as proteins or the encoding nucleic acids, that is structurally and/or functionally distinct from other portions of the molecule and is identifiable. An exemplary polypeptide domain is a part of the polypeptide that can form an independently folded structure within a polypeptide made up of one or more structural motifs (e.g., combinations of alpha helices and/or beta strands connected by loop regions) and/or that is recognized by a particular functional activity, such as enzymatic activity, dimerization or substrate-binding. A polypeptide can have one or more, typically more than one, distinct domains. For example, the polypeptide can have one or more structural domains and one or more functional domains. A single polypeptide domain can be distinguished based on structure and function. A domain can encompass a contiguous linear sequence of amino acids. Alternatively, a domain can encompass a plurality of non-contiguous amino acid portions, which are non-contiguous along the linear sequence of amino acids of the polypeptide. Typically, a polypeptide contains a plurality of domains. For example, serine proteases can be characterized based on the sequence of protease domain(s). Those of skill in the art are familiar with polypeptide domains and can identify them by virtue of structural and/or functional homology with other such domains. For exemplification herein, definitions are provided, but it is understood that it is well within the skill in the art to recognize particular domains by name. If needed, appropriate software can be employed to identify domains.

As used herein, a "structural region" of a polypeptide is a region of the polypeptide that contains at least one structural domain.

As used herein, a "protease domain" is the catalytically active portion of a protease. Reference to a protease domain of a protease includes the single, two- and multi-chain forms of any of these proteins. A protease domain of a protein contains all of the requisite properties of that protein required for its proteolytic activity, such as for example, its catalytic center.

As used herein, a "catalytically active portion" or "catalytically active domain" of a protease, for example a u-PA polypeptide, refers to the protease domain, or any fragment or portion thereof that retains protease activity. For example, a catalytically active portion of a u-PA polypeptide can be a u-PA protease domain including an isolated single chain form of the protease domain or an activated two-chain form. Significantly, at least in vitro, the single chain forms of the proteases and catalytic domains or proteolytically active portions thereof (typically C-terminal truncations) exhibit protease activity.

As used herein, a "nucleic acid encoding a protease domain or catalytically active portion of a protease" refers to a nucleic acid encoding only the recited single chain protease domain or active portion thereof, and not the other contiguous portions of the protease as a continuous sequence.

As used herein, recitation that a polypeptide consists essentially of the protease domain means that the only portion of the polypeptide is a protease domain or a catalytically active portion thereof. The polypeptide optionally can, and generally include additional non-protease-derived sequences of amino acids.

As used herein, an "active site of a protease" refers to the substrate binding site where catalysis of the substrate occurs. The structure and chemical properties of the active site allow the recognition and binding of the substrate and subsequent hydrolysis and cleavage of the scissile bond in the substrate. The active site of a protease contains amino acids that contribute to the catalytic mechanism of peptide cleavage, such as amino acids Gln His Ala Arg Ala Ser His Leu (active site of C3; residues 737-744 of SEQ ID NO:47) as well as amino acids that contribute to substrate sequence recognition, such as amino acids that contribute to extended substrate binding specificity. For example, cleavage in the active site of C3 can inhibit its activity, such as:

```
(residues 737-744 of SEQ ID NO: 47)
 Q   H   A   R  ↓ A   S   H   L
 P4  P3  P2  P1 ↓P1' P2' P3' P4'.
```

As used herein, the "substrate recognition site" or "cleavage sequence" refers to the sequence recognized by the active site of a protease that is cleaved by a protease. Typically, a cleavage sequence for a serine protease is six residues in length to match the extended substrate specificity of many proteases, but can be longer or shorter depending upon the protease. Typically, for example, for a serine protease, a cleavage sequence is made up of the P1-P4 and P1'-P4' amino acids in a substrate, where cleavage occurs after the P1 position. Typically, a cleavage sequence for a serine protease is six residues in length to match the extended substrate specificity of many proteases, but can be longer or shorter depending upon the protease.

As used herein, "target substrate" refers to a substrate that is cleaved by a protease. Typically, the target substrate is specifically cleaved at its substrate recognition site by a protease. Minimally, a target substrate includes the amino acids that make up the cleavage sequence. Optionally, a target substrate includes a peptide containing the cleavage sequence and any other amino acids. A full-length protein, allelic variant, isoform, or any portion thereof, containing a cleavage sequence recognized by a protease, is a target substrate for that protease. For example, for purposes herein in which complement inactivation is intended, a target substrate is complement protein C3, or any portion or fragment thereof containing a cleavage sequence recognized by a u-PA polypeptide. Such target substrates can be purified proteins, or can be present in a mixture, such as a mixture in vitro or a mixture in vivo. Mixtures can include, for example, blood or serum, or other tissue fluids. Additionally, a target substrate includes a peptide or protein containing an additional moiety that does not affect cleavage of the substrate by a protease. For example, a target substrate can include a four amino acid peptide or a full-length protein chemically linked to a fluorogenic moiety. The proteases can be modified to exhibit greater substrate specificity for a target substrate.

As used herein, "u-PA" or "uPA" or "u-PA polypeptide" refers to any u-PA polypeptide including, but not limited to, a recombinantly produced polypeptide, a synthetically produced polypeptide and a u-PA polypeptide extracted or isolated from cells or tissues including, but not limited to, liver and blood. Alternative names that are used interchangeably for u-PA include urokinase and urinary plasminogen activator and urokinase plasminogen activator and urinary-type plasminogen activator and urokinase-type plasminogen activator. u-PA includes related polypeptides from different species including, but not limited to animals of human and non-human origin. Human u-PA includes u-PA, allelic variants, isoforms, synthetic molecules from nucleic acids, protein isolated from human tissue and cells, and modified forms thereof. Exemplary unmodified human u-PA polypeptides include, but are not limited to, unmodified and wild-type native mature u-PA polypeptides (SEQ ID NO:3), the unmodified and wild-type precursor u-PA polypeptide that includes a propeptide and/or signal peptides (such as the u-PA polypeptide set forth in SEQ ID NO:1) and the protease domain (such as the u-PA protease domain set forth in SEQ ID NO: 2). One of skill in the art would recognize that the referenced positions of the mature u-PA polypeptide (SEQ ID NO:3) differ by 20 amino acid residues when compared to the precursor u-PA polypeptide (SEQ ID NO:1), which is the u-PA polypeptide containing the signal peptide sequence. Thus, the first amino acid residue of SEQ ID NO:3 "corresponds to" the twenty-first (21st) amino acid residue of SEQ ID NO:1.

Recitation of "u-PA" encompasses the activated or two-chain form of the u-PA polypeptide containing the N-terminal A chain (amino acids 1-158 of SEQ ID NO:3) and the C-terminal B chain (amino acids 159-411 of SEQ ID NO:3) linked by a disulfide bond between residues 148C and 279C (corresponding to the mature u-PA polypeptide set forth in SEQ ID NO:3). The two-chain form, or high molecular weight (HMW) u-PA, is formed from a mature u-PA polypeptide (e.g., that set forth in SEQ ID NO:3) by proteolytic cleavage after amino acid residue Lys158 before residue Ile159. Proteolytic cleavage can be carried out, for example, by plasmin, kallikrein, cathepsin B, matriptase and nerve growth factor-γ (gamma). The u-PA polypeptides provided herein can be further modified, such as by chemical modification or post-translational modification. Such modifications include, but are not limited to, glycosylation, pegylation, albumination, farnysylation, carboxylation, hydroxylation, phosphorylation, and other polypeptide modifications known in the art.

u-PA includes u-PA from any species, including human and non-human species. u-PA polypeptides of non-human origin include, but are not limited to, murine, canine, leporine, avian, bovine, ovine, porcine and other primate u-PA polypeptides. Exemplary u-PA polypeptides of non-human origin include, for example, mouse (*Mus musculus*, SEQ ID NO:52), rat (*Rattus norvegicus*, SEQ ID NO:53), cow (*Bos taurus*, SEQ ID NO:54), pig (*Sus scrofa*, SEQ ID NO:55), rabbit (*Oryctolagus cuniculus*, SEQ ID NO:56), chicken (*Gallus gallus*, SEQ ID NO:57), yellow baboon (*Papio cynocephalus*, SEQ ID NO:58), Sumatran orangutan (*Pongo abelii*, SEQ ID NO:59), dog (*Canis lupus*, SEQ ID NO:60), sheep (*Ovis aries*, SEQ ID NO:61), marmoset (*Callithrix jacchus*, SEQ ID NO:62), rhesus monkey (*Macaca mulatta*, SEQ ID NO:63), northern white-cheeked gibbon (*Nomascus leucogenys*, SEQ ID NO:64) and chimpanzee (*Pan troglodytes*, SEQ ID NO:65).

Reference to u-PA polypeptides also includes precursor polypeptides and mature u-PA polypeptides in single-chain or two-chain forms, truncated forms thereof that have activity, the isolated protease domain and includes allelic variants and species variants, variants encoded by splice variants, and other variants, including polypeptides that have at least or at least about 40%, 45%, 50%, 55%, 65%, 70%, 75%, 80%, 85%, 90%, 95%, 96%, 97%, 98%, 99% or more sequence identity to the precursor polypeptide set forth in SEQ ID NO:1 or the mature form thereof (SEQ ID NO:3) or the protease domain thereof (SEQ ID NO: 2). u-PA polypeptides include, but are not limited to, tissue-specific isoforms and allelic variants thereof, synthetic molecules prepared by translation of nucleic acids, proteins generated by chemical synthesis, such as syntheses that include ligation of shorter polypeptides, through recombinant methods, proteins isolated from human and non-human tissue and cells, chimeric u-PA polypeptides and modified forms thereof. u-PA polypeptides also include fragments or portions of u-PA that are of sufficient length or include appropriate regions to retain at least one activity (upon activation if needed) of a full-length mature polypeptide. In one example the portion of u-PA is the protease domain, such as, for example, the protease domain set forth in SEQ ID NO: 2 which corresponds to amino acids 179-431 of the u-PA sequence set forth in SEQ ID NO: 1. u-PA polypeptides also include those that contain chemical or posttranslational modifications and those that do not contain chemical or posttranslational modifications. Such modifications include, but are not limited to, pegylation, albumination, glycosylation, farnysylation, carboxylation, hydroxylation, phosphorylation, HESylation (half-life extension by on coupling drug molecules to the biodegradable hydroxyethyl starch (HES)), PASylation (conjugation via genetic fusion or chemical coupling of pharmacologically active compounds, such as proteins, peptides and low molecular weight drugs, with natively disordered biosynthetic polymers made of the small L-amino acids Pro, Ala and/or Ser), and other polypeptide modifications known in the art.

As used herein, "u-PA protease" or "u-PA protease domain" refers to any u-PA polypeptide including, but not limited to, a recombinantly produced polypeptide, a synthetically produced polypeptide and a u-PA polypeptide extracted or isolated from cells or tissues including, but not limited to, liver and blood. u-PA protease includes related polypeptides from different species including, but not limited to animals of human and non-human origin. A human u-PA protease or u-PA protease domain includes u-PA, allelic variants, isoforms, synthetic molecules from nucleic acids, protein isolated from human tissue and cells, and modified forms thereof. Exemplary reference human u-PA protease domains include, but are not limited to, unmodified and wild-type u-PA protease domain (SEQ ID NO:2) and an alternate protease domain (such as the u-PA protease domain set forth in SEQ ID NO: 5). One of skill in the art would recognize that the referenced positions of the u-PA protease domain (SEQ ID NO:2) differ by 178 amino acid residues when compared to the mature u-PA polypeptide (SEQ ID NO:1), which is the u-PA polypeptide containing the full length WT sequence. Thus, the first amino acid residue of SEQ ID NO:2 "corresponds to" the one hundred seventy-ninth (179th) amino acid residue of SEQ ID NO:1.

As used herein, a "modification" is in reference to modification of a sequence of amino acids of a polypeptide or a sequence of nucleotides in a nucleic acid molecule and includes deletions, insertions, and replacements of amino acids or nucleotides, respectively. Methods of modifying a polypeptide are routine to those of skill in the art, such as by using recombinant DNA methodologies. There is a distinction between modifications to the sequence of amino acids of polypeptide and modification of the polypeptide. The former refers to insertions, deletions, and replacements or substitutions of amino acids; the latter to modifications of the polypeptide, such as post-translational modifications, PEGylation, and other such modifications of proteins to alter properties and/or activities.

As used herein, "substitution" or "replacement" refers to the replacing of one or more nucleotides or amino acids in a native, target, wild-type or other nucleic acid or polypeptide sequence with an alternative nucleotide or amino acid, without changing the length (as described in numbers of residues) of the molecule. Thus, one or more substitutions in a molecule does not change the number of amino acid residues or nucleotides of the molecule. Amino acid replacements compared to a particular polypeptide can be expressed in terms of the number of the amino acid residue along the length of the polypeptide sequence. For example, a modified polypeptide having a modification in the amino acid at the 35$^{th}$ position of the amino acid sequence that is a substitution/replacement of Arginine (Arg; R) with glutamine (Gln; Q) can be expressed as R35Q, Arg35Gln, or 35Q. Simply R35 can be used to indicate that the amino acid at the modified 35$^{th}$ position is an arginine.

As used herein, a "modified u-PA" or "modified u-PA polypeptide" refers to a u-PA protease that exhibits altered activity, such as altered substrate specificity, compared to the unmodified form. Such proteases include 1, 2, 3, 4, 5, 6, 7, 8, 9, 10, 11, 12, 13, 14, 15, 16, 17, 18, 19, 20, or more modifications (i.e. changes in amino acids) compared to a wild type u-PA such that an activity, such as substrate specificity or selectivity, of the u-PA protease for cleaving complement protein C3 is altered. A modified u-PA can be a full-length u-PA protease, or can be a portion thereof of a full length protease, such as the protease domain of u-PA, as long as the modified u-PA protease contains modifications in regions that alter the activity or substrate specificity of the protease and the protease is proteolytically active. A modified u-PA protease, or a modified u-PA protease domain, also can include other modifications in regions that do not impact on substrate specificity of the protease. Hence, a modified u-PA polypeptide typically has 60%, 70%, 80%, 85%, 90%, 91%, 92%, 93%, 94%, 95%, 96%, 97%, 98%, 99% or more sequence identity to a corresponding sequence of amino acids of a wild type u-PA polypeptide. A modified full-length u-PA polypeptide or a catalytically active portion thereof or a protease domain thereof of a modified u-PA polypeptide can include polypeptides that are fusion proteins as long as the fusion protein possesses the target specificity.

As used herein, chymotrypsin numbering refers to the amino acid numbering of a mature chymotrypsin polypeptide of SEQ ID NO:76. Alignment of a protease domain of another protease, such as, for example, the protease domain of u-PA, can be made with chymotrypsin. In such an instance, the amino acids of u-PA polypeptide that correspond to amino acids of chymotrypsin are given the numbering of the chymotrypsin amino acids. Corresponding positions can be determined by such alignment by one of skill in the art using manual alignments or by using the numerous alignment programs available (for example, BLASTP). Corresponding positions also can be based on structural alignments, for example by using computer simulated alignments of protein structure. Recitation that amino acids of a polypeptide correspond to amino acids in a disclosed sequence refers to amino acids identified upon alignment of the polypeptide with the disclosed sequence to maximize identity or homology (where conserved amino acids are aligned) using a standard alignment algorithm, such as the GAP algorithm. The corresponding chymotrypsin numbers of amino acid positions 159-411 of the u-PA polypeptide set forth in SEQ ID NO:3 are provided in Table 1. The amino acid positions relative to the sequence set forth in SEQ ID NO:3 are in normal font, the amino acid residues at those positions are in bold, and the corresponding chymotrypsin numbers are in italics. For example, upon alignment of the serine protease domain of u-PA (SEQ ID NO:2) with mature chymotrypsin, the isoleucine (I) at position 159 in u-PA is given the chymotrypsin numbering of 116. Subsequent amino acids are numbered accordingly. In one example, a phenylalanine (F) at amino acid position 173 of mature u-PA (SEQ ID NO:3) corresponds to amino acid position F30 based on chymotrypsin numbering. Where a residue exists in a protease, but is not present in chymotrypsin, the amino acid residue is given a letter notation. For example, residues in chymotrypsin that are part of a loop with amino acid 60 based on chymotrypsin numbering, but are inserted in the u-PA sequence compared to chymotrypsin, are referred to for example as D60a, Y60b or P60c. These residues correspond to D208, Y209 and P210, respectively, by numbering relative to the mature u-PA sequence set forth in SEQ ID NO:3.

TABLE 1

| Chymotrypsin numbering of u-PA | | | | | | | | | | | | | | |
|---|---|---|---|---|---|---|---|---|---|---|---|---|---|---|
| 159 | 160 | 161 | 162 | 163 | 164 | 165 | 166 | 167 | 168 | 169 | 170 | 171 | 172 | 173 |
| I | I | G | G | E | F | T | T | I | E | N | Q | P | W | F |
| *16* | *17* | *18* | *19* | *20* | *21* | *22* | *23* | *24* | *25* | *26* | *27* | *28* | *29* | *30* |
| 174 | 175 | 176 | 177 | 178 | 179 | 180 | 181 | 182 | 183 | 184 | 185 | 186 | 187 | 188 |
| A | A | I | Y | R | R | H | R | G | G | S | V | T | Y | V |
| *31* | *32* | *33* | *34* | *35* | *36* | *37* | *37A* | *37B* | *37C* | *37D* | *38* | *39* | *40* | *41* |
| 189 | 190 | 191 | 192 | 193 | 194 | 195 | 196 | 197 | 198 | 199 | 200 | 201 | 202 | 203 |
| C | G | G | S | L | I | S | P | C | W | V | I | S | A | T |
| *42* | *43* | *44* | *45* | *46* | *47* | *48* | *49* | *50* | *51* | *52* | *53* | *54* | *55* | *56* |

TABLE 1-continued Chymotrypsin numbering of u-PA

| 204 | 205 | 206 | 207 | 208 | 209 | 210 | 211 | 212 | 213 | 214 | 215 | 216 | 217 | 218 |
|---|---|---|---|---|---|---|---|---|---|---|---|---|---|---|
| H 57 | C 58 | F 59 | I 60 | D 60A | Y 60B | P 60C | K 61 | K 62 | E 62A | D 63 | Y 64 | I 65 | V 66 | Y 67 |

| 219 | 220 | 221 | 222 | 223 | 224 | 225 | 226 | 227 | 228 | 229 | 230 | 231 | 232 | 233 |
|---|---|---|---|---|---|---|---|---|---|---|---|---|---|---|
| L 68 | G 69 | R 70 | S 71 | R 72 | L 73 | N 74 | S 75 | N 76 | T 77 | Q 78 | G 79 | E 80 | M 81 | K 82 |

| 234 | 235 | 236 | 237 | 238 | 239 | 240 | 241 | 242 | 243 | 244 | 245 | 246 | 247 | 248 |
|---|---|---|---|---|---|---|---|---|---|---|---|---|---|---|
| F 83 | E 84 | V 85 | E 86 | N 87 | L 88 | I 89 | L 90 | H 91 | K 92 | D 93 | Y 94 | S 95 | A 96 | D 97 |

| 249 | 250 | 251 | 252 | 253 | 254 | 255 | 256 | 257 | 258 | 259 | 260 | 261 | 262 | 263 |
|---|---|---|---|---|---|---|---|---|---|---|---|---|---|---|
| T 97A | L 97B | A 98 | H 99 | H 100 | N 101 | D 102 | I 103 | A 104 | L 105 | L 106 | K 107 | I 108 | R 109 | S 110 |

| 264 | 265 | 266 | 267 | 268 | 269 | 270 | 271 | 272 | 273 | 274 | 275 | 276 | 277 | 278 |
|---|---|---|---|---|---|---|---|---|---|---|---|---|---|---|
| K 110A | E 110B | G 110C | R 110D | C 111 | A 112 | Q 113 | P 114 | S 115 | R 116 | T 117 | I 118 | Q 119 | T 120 | I 121 |

| 279 | 280 | 281 | 282 | 283 | 284 | 285 | 286 | 287 | 288 | 289 | 290 | 291 | 292 | 293 |
|---|---|---|---|---|---|---|---|---|---|---|---|---|---|---|
| C 122 | L 123 | P 124 | S 125 | M 126 | Y 127 | N 128 | D 129 | P 130 | Q 131 | F 132 | G 133 | T 134 | S 135 | C 136 |

| 294 | 295 | 296 | 297 | 298 | 299 | 300 | 301 | 302 | 303 | 304 | 305 | 306 | 307 | 308 |
|---|---|---|---|---|---|---|---|---|---|---|---|---|---|---|
| E 137 | I 138 | T 139 | G 140 | F 141 | G 142 | K 143 | E 144 | N 145 | S 146 | T 147 | D 148 | Y 149 | L 150 | Y 151 |

| 309 | 310 | 311 | 312 | 313 | 314 | 315 | 316 | 317 | 318 | 319 | 320 | 321 | 322 | 323 |
|---|---|---|---|---|---|---|---|---|---|---|---|---|---|---|
| P 152 | E 153 | Q 154 | L 155 | K 156 | M 157 | T 158 | V 159 | V 160 | K 161 | L 162 | I 163 | S 164 | H 165 | R 166 |

| 324 | 325 | 326 | 327 | 328 | 329 | 330 | 331 | 332 | 333 | 334 | 335 | 336 | 337 | 338 |
|---|---|---|---|---|---|---|---|---|---|---|---|---|---|---|
| E 167 | C 168 | Q 169 | Q 170 | P 170A | H 170B | Y 171 | Y 172 | G 173 | S 174 | E 175 | V 176 | T 177 | T 178 | K 179 |

| 339 | 340 | 341 | 342 | 343 | 344 | 345 | 346 | 347 | 348 | 349 | 350 | 351 | 352 | 353 |
|---|---|---|---|---|---|---|---|---|---|---|---|---|---|---|
| M 180 | L 181 | C 182 | A 183 | A 184 | D 185 | P 185A | Q 185B | W 186 | K 187 | T 188 | D 189 | S 190 | C 191 | Q 192 |

| 354 | 355 | 356 | 357 | 358 | 359 | 360 | 361 | 362 | 363 | 364 | 365 | 366 | 367 | 368 |
|---|---|---|---|---|---|---|---|---|---|---|---|---|---|---|
| G 193 | D 194 | S 195 | G 196 | G 197 | P 198 | L 199 | V 200 | C 201 | S 202 | L 203 | Q 204 | G 205 | R 206 | M 207 |

| 369 | 370 | 371 | 372 | 373 | 374 | 375 | 376 | 377 | 378 | 379 | 380 | 381 | 382 | 383 |
|---|---|---|---|---|---|---|---|---|---|---|---|---|---|---|
| T 208 | L 209 | T 210 | G 211 | I 212 | V 213 | S 214 | W 215 | G 216 | R 217 | G 218 | C 220 | A 221 | L 222 | K 223 |

| 384 | 385 | 386 | 387 | 388 | 389 | 390 | 391 | 392 | 393 | 394 | 395 | 396 | 397 | 398 |
|---|---|---|---|---|---|---|---|---|---|---|---|---|---|---|
| D 223A | K 224 | P 225 | G 226 | V 227 | Y 228 | T 229 | R 230 | V 231 | S 232 | H 233 | F 234 | L 235 | P 236 | W 237 |

| 399 | 400 | 401 | 402 | 403 | 404 | 405 | 406 | 407 | 408 | 409 | 410 | 411 | | |
|---|---|---|---|---|---|---|---|---|---|---|---|---|---|---|
| I 238 | R 239 | S 240 | H 241 | T 242 | K 243 | E 244 | E 245 | N 246 | G 247 | L 248 | A 249 | L 250 | | |

As used herein, $k_{cat}$ measures the catalytic activity of an enzyme; the units of $k_{cat}$ are seconds$^{-1}$. The reciprocal of $k_{cat}$ is the time required by an enzyme molecule to "turn over" one substrate molecule; $k_{cat}$ measures the number of substrate molecules turned over per enzyme molecule per second. $k_{cat}$ is sometimes called the turnover number. In enzymology, $k_{cat}$ (also referred to as turnover number) is the maximum number of chemical conversions of substrate molecules per second that a single catalytic site executes for a given enzyme. It is the maximum rate of reaction ($V_{max}$) when all the enzyme catalytic sites are saturated with substrate.

As used herein, specificity for a target substrate refers to a preference for cleavage of a target substrate by a protease compared to another substrate, referred to as a non-target substrate. Specificity is reflected in the specificity constant ($k_{cat}/K_m$), which is a measure of the affinity of a protease for its substrate and the efficiency of the enzyme. $k_{cat}/K_m$ is a measure of enzyme efficiency; a large value of $k_{cat}$ (rapid turnover) or a small value of $K_m$ (high affinity for substrate) makes $k_{cat}/K_m$ large.

As used herein, a specificity constant for cleavage is ($k_{cat}/K_m$), where $K_m$ is the Michaelis-Menton constant ([S] at one half $V_{max}$) and $k_{cat}$ is the $V_{max}/[ET]$, where ET is the final enzyme concentration. The parameters $k_{cat}$, $K_m$ and $k_{cat}/K_m$ can be calculated by graphing the inverse of the substrate concentration versus the inverse of the velocity of substrate cleavage, and fitting to the Lineweaver-Burk equation (1/velocity=($K_m/V_{max}$)(1/[S])+1/$V_{max}$; where $V_{max}$=[ET]$k_{cat}$). Any method to determine the rate of increase of cleavage over time in the presence of various concentrations of substrate can be used to calculate the specificity constant. For example, a substrate is linked to a fluorogenic moiety, which is released upon cleavage by a protease. By determining the rate of cleavage at different enzyme concentrations, $k_{cat}$ can be determined for a particular protease. The specificity constant can be used to determine the preference of a protease for one target substrate over another substrate.

As used herein, substrate specificity refers to the preference of a protease for one target substrate over another. Substrate specificity can be measured as a ratio of specificity constants.

As used herein, a substrate specificity ratio is the ratio of specificity constants and can be used to compare specificities of two or more proteases or a protease for two or more substrates. For example, substrate specificity of a protease for competing substrates or of competing proteases for a substrate can be compared by comparing $k_{cat}/K_m$. For example, a protease that has a specificity constant of $2 \times 10^6$ $M^{-1}$ $sec^{-1}$ for a target substrate and $2 \times 10^4$ $M^{-1}$ $sec^{-1}$ for a non-target substrate is more specific for the target substrate. Using the specificity constants from above, the protease has a substrate specificity ratio of 100 for the target substrate.

As used herein, preference or substrate specificity for a target substrate can be expressed as a substrate specificity ratio. The particular value of the ratio that reflects a preference is a function of the substrates and proteases at issue. A substrate specificity ratio that is greater than 1 signifies a preference for a target substrate and a substrate specificity less than 1 signifies a preference for a non-target substrate. Generally, a ratio of at least or about 1 reflects a sufficient difference for a protease to be considered a candidate therapeutic.

As used herein, altered specificity refers to a change in substrate specificity of a modified protease compared to a starting wild type protease. Generally, the change in specificity is a reflection of the change in preference of a modified protease for a target substrate compared to a wild type substrate of the protease (herein referred to as a non-target substrate). Typically, modified u-PA proteases provided herein exhibit increased substrate specificity for complement protein C3 compared to the substrate specificity of the wild type u-PA protease. For example, a modified protease that has a substrate specificity ratio of 100 for a target substrate versus a non-target substrate exhibits a 10-fold increased specificity compared to a scaffold protease with a substrate specificity ratio of 10. In another example, a modified protease that has a substrate specificity ratio of 1 compared to a ratio of 0.1, exhibits a 10-fold increase in substrate specificity. To exhibit increased specificity compared to a scaffold protease, a modified protease has a 1.5-fold, 2-fold, 5-fold, 10-fold, 50-fold, 100-fold, 200-fold, 300-fold, 400-fold, 500-fold or more greater substrate specificity for any one of more of the complement proteins.

As used herein, "selectivity" can be used interchangeably with specificity when referring to the ability of a protease to choose and cleave one target substrate from among a mixture of competing substrates. Increased selectivity of a protease for a target substrate compared to any other one or more target substrates can be determined, for example, by comparing the specificity constants of cleavage of the target substrates by a protease. For example, if a protease has a specificity constant of cleavage of $2 \times 10^6$ $M^{-1}$ $sec^{-1}$ for a target substrate and $2 \times 10^4$ $M^{-1}$ $sec^{-1}$ for any other one of more substrates, the protease is more selective for the target substrate.

As used herein, an "activity" or a "functional activity" of a polypeptide, such as a protease, refers to any activity exhibited by the polypeptide. Such activities can be empirically determined. Exemplary activities include, but are not limited to, ability to interact with a biomolecule, for example, through substrate-binding, DNA binding, or dimerization, enzymatic activity, for example, kinase activity or proteolytic activity. For a protease (including protease fragments), activities include, but are not limited to, the ability to specifically bind a particular substrate, affinity and/or specificity of substrate-binding (e.g., high or low affinity and/or specificity), effector functions, such as the ability to promote substrate (e.g. protein, i.e. C3) inhibition, neutralization, cleavage or clearance, and in vivo activities, such as the ability to promote protein cleavage or clearance. Activity can be assessed in vitro or in vivo using recognized assays, such as ELISA, flow cytometry, surface plasmon resonance or equivalent assays to measure on- or off-rate, immunohistochemistry and immunofluorescence histology and microscopy, cell-based assays, and binding assays. For example, for a protease, e.g. a modified u-PA protease, activities can be assessed by measuring substrate protein cleavage, turnover, residual activity, stability and/or levels in vitro and/or in vivo. The results of such in vitro assays that indicate that a polypeptide exhibits an activity can be correlated to activity of the polypeptide in vivo, in which in vivo activity can be referred to as therapeutic activity, or biological activity. Activity of a modified polypeptide can be any level of percentage of activity of the unmodified polypeptide, including, but not limited to, at or about 1% of the activity, 2%, 3%, 4%, 5%, 10%, 20%, 30%, 40%, 50%, 60%, 70%, 80%, 90%, 91%, 92%, 93%, 94%, 95%, 96%, 97%, 98%, 99%, 100%, 200%, 300%, 400%, 500%, or more of activity compared to the unmodified polypeptide. Assays to determine functionality or activity of modified (or variant) proteases are well-known in the art.

Functional activities include, but are not limited to, biological activity, catalytic or enzymatic activity, antigenicity (ability to bind to or compete with a polypeptide for binding to an anti-polypeptide antibody), immunogenicity, ability to form multimers, and the ability to specifically bind to a receptor or ligand for the polypeptide.

As used herein, a functional activity with reference to a complement protein refers to a complement-mediated function including, but not limited to, anaphylaxis, opsonization, chemotaxis, or cell lysis. Exemplary of assays for testing activities of complement activity include hemolysis of red blood cells, and detection of complement effector molecules such as by ELISA or SDS-PAGE.

As used herein, catalytic activity or cleavage activity refers to the activity of a protease as assessed in in vitro proteolytic assays that detect proteolysis of a selected substrate. Cleavage activity can be measured by assessing catalytic efficiency of a protease.

As used herein, activity towards a target substrate refers to cleavage activity and/or functional activity, or other measurement that reflects the activity of a protease on or towards a target substrate. A functional activity of a complement protein target substrate by a protease can be measured by assessing an IC50 in a complement assay such as red blood cell lysis, or other such assays known by one of skill in the art or provided herein to assess complement activity. Cleavage activity can be measured by assessing catalytic efficiency of a protease. For purposes herein, an activity is increased if a protease exhibits greater proteolysis or cleavage of a target substrate and/or modulates (i.e. activates or inhibits) a functional activity of a complement protein as compared to in the absence of the protease.

As used herein, "increased activity" with reference to a modified u-PA polypeptide means that, when tested under the same conditions, the modified u-PA polypeptide exhibits greater activity compared to an unmodified u-PA polypeptide not containing the amino acid replacement(s). For example, a modified u-PA polypeptide exhibits at least or about at least 110%, 120%, 130%, 140%, 150%, 160%, 170%, 180%, 190%, 200%, 250%, 300%, 400%, 500%, 600%, 700%, 800%, 900%, 1000% or more of the activity of the unmodified or reference u-PA polypeptide.

As used herein, the term "the same," when used in reference to antibody binding affinity, means that the $EC_{50}$, association constant (Ka) or dissociation constant (Kd) is within about 1 to 100 fold or 1 to 10 fold of that of the reference antibody (1-100 fold greater affinity or 1-100 fold less affinity, or any numerical value or range or value within such ranges, than the reference antibody).

As used herein, "binding activity" refers to characteristics of a molecule, e.g., a polypeptide, relating to whether or not, and how, it binds one or more binding partners. Binding activities include the ability to bind the binding partner(s), the affinity with which it binds to the binding partner (e.g., high affinity), the strength of the bond with the binding partner and/or specificity for binding with the binding partner.

As used herein, $EC_{50}$, also called the apparent Kd, is the concentration (e.g., nM) of protease, where 50% of the maximal activity is observed on a fixed amount of substrate (e.g., the concentration of modified u-PA polypeptide required to cleave through 50% of the available hC3). Typically, $EC_{50}$ values are determined from sigmoidal dose-response curves, where the $EC_{50}$ is the concentration at the inflection point. A high protease affinity for its substrate correlates with a low $EC_{50}$ value and a low affinity corresponds to a high $EC_{50}$ value. Affinity constants can be determined by standard kinetic methodology for protease reactions, for example, immunoassays, such as ELISA, followed by curve-fitting analysis.

As used herein, "affinity constant" refers to an association constant (Ka) used to measure the affinity or molecular binding strength between a protease and a substrate. The higher the affinity constant the greater the affinity of the protease for the substrate. Affinity constants are expressed in units of reciprocal molarity (i.e., $M^{-1}$ and can be calculated from the rate constant for the association-dissociation reaction as measured by standard kinetic methodology for protease-substrate reactions (e.g., immunoassays, surface plasmon resonance, or other kinetic interaction assays known in the art). The binding affinity of a protease also can be expressed as a dissociation constant, or Kd. The dissociation constant is the reciprocal of the association constant, Kd=1/Ka. Hence, an affinity constant also can be represented by the Kd. Affinity constants can be determined by standard kinetic methodology for protease reactions, for example, immunoassays, surface plasmon resonance (SPR) (Rich and Myszka (2000) *Curr. Opin. Biotechnol* 11:54; Englebienne (1998) *Analyst.* 123:1599), isothermal titration calorimetry (ITC) or other kinetic interaction assays known in the art (see, e.g., Paul, ed., Fundamental Immunology, 2nd ed., Raven Press, New York, pages 332-336 (1989)). Instrumentation and methods for real time detection and monitoring of binding rates are known and are commercially available (e.g., BIAcore 2000, BIAcore AB, Uppsala, Sweden and GE Healthcare Life Sciences; Malmqvist (2000) *Biochem. Soc. Trans.* 27:335).

Methods for calculating affinity are well-known, such as methods for determining $EC_{50}$ values or methods for determining association/dissociation constants, including those exemplified herein. For example, with respect to $EC_{50}$, high binding affinity means that the protease specifically binds to a target protein with an $EC_{50}$ that is less than about 10 ng/mL, 9 ng/mL, 8 ng/mL, 7 ng/mL, 6 ng/mL, 5 ng/mL, 3 ng/mL, 2 ng/mL, 1 ng/mL or less. High binding affinity also can be characterized by an equilibrium dissociation constant (Kd) of $10^{-6}$ M or lower, such as $10^{-7}$ M, $10^{-8}$ M, $10^{-10}$ M, $10^{-11}$ M or $10^{-12}$ M or lower. In terms of equilibrium association constant (Ka), high binding affinity is generally associated with Ka values of greater than or equal to about $10^6$ $M^{-1}$, greater than or equal to about $10^7$ $M^{-1}$, greater than or equal to about $10^8$ $M^{-1}$, or greater than or equal to about $10^9$ $M^{-1}$, $10^{10}$ $M^{-1}$, $10^{11}$ $M^{-1}$ or $10^{12}$ $M^{-1}$. Affinity can be estimated empirically or affinities can be determined comparatively, e.g., by comparing the affinity of two or more antibodies for a particular antigen, for example, by calculating pairwise ratios of the affinities of the antibodies tested. For example, such affinities can be readily determined using conventional techniques, such as by ELISA; equilibrium dialysis; surface plasmon resonance; by radioimmunoassay using radiolabeled target antigen; or by another method known to the skilled artisan. The affinity data can be analyzed, for example, by the method of Scatchard et al., *Ann N.Y. Acad. Sci.*, 51:660 (1949) or by curve fitting analysis, for example, using a 4 Parameter Logistic nonlinear regression model using the equation: $y=((A-D)/(1+((x/C)^B)))+D$, where A is the minimum asymptote, B is the slope factor, C is the inflection point ($EC_{50}$), and D is the maximum asymptote.

As used herein, "$ED_{50}$" is the dose (e.g., mg/kg or nM) of a protease (e.g., a modified u-PA) that produces a specified result (e.g., cleavage of the complement protein C3) in 50% of the total population (e.g., total amount of C3 present in the sample).

As used herein, the term "surface plasmon resonance" refers to an optical phenomenon that allows for the analysis of real-time interactions by detection of alterations in protein concentrations within a biosensor matrix, for example, using the BIAcore system (GE Healthcare Life Sciences).

As used herein, a human protein is one encoded by a nucleic acid molecule, such as DNA, present in the genome of a human, including all allelic variants and conservative variations thereof. A variant or modification of a protein is a human protein if the modification is based on the wild type or prominent sequence of a human protein.

As used herein, the residues of naturally occurring α-amino acids are the residues of those 20 α-amino acids found in nature which are incorporated into protein by the specific recognition of the charged tRNA molecule with its cognate mRNA codon in humans.

As used herein, non-naturally occurring amino acids refer to amino acids that are not genetically encoded.

As used herein, "nucleic acid" refers to at least two linked nucleotides or nucleotide derivatives, including a deoxyribonucleic acid (DNA) and a ribonucleic acid (RNA) and analogs thereof, joined together, typically by phosphodiester linkages. Also included in the term "nucleic acid" are analogs of nucleic acids such as peptide nucleic acid (PNA), phosphorothioate DNA, and other such analogs and derivatives or combinations thereof. Nucleic acids also include DNA and RNA derivatives containing, for example, a nucleotide analog or a "backbone" bond other than a phosphodiester bond, for example, a phosphotriester bond, a phosphoramidate bond, a phosphorothioate bond, a thioester bond, or a peptide bond (peptide nucleic acid). The term also includes, as equivalents, derivatives, variants and analogs of either RNA or DNA made from nucleotide analogs, single (sense or antisense) and double-stranded nucleic acids. Deoxyribonucleotides include deoxyadenosine, deoxycytidine, deoxyguanosine and deoxythymidine. For RNA, the uracil base is uridine. Nucleic acids can be single or double-stranded. When referring to probes or primers, which are optionally labeled, such as with a detectable label, such as a fluorescent or radiolabel, single-stranded molecules are contemplated. Such molecules are typically of a length such that their target is statistically unique or of low copy number (typically less than 5, generally less than 3) for probing or priming a library. Generally a probe or primer contains at least 14, 16 or 30 contiguous nucleotides of sequence complementary to or identical to a gene of interest. Probes and primers can be 10, 20, 30, 50, 100 or more nucleotides long.

As used herein, an "isolated nucleic acid molecule" is one which is separated from other nucleic acid molecules which are present in the natural source of the nucleic acid molecule. An "isolated" nucleic acid molecule, such as a cDNA molecule, can be substantially free of other cellular material, or culture medium when produced by recombinant techniques, or substantially free of chemical precursors or other chemicals when chemically synthesized. Exemplary isolated nucleic acid molecules provided herein include isolated nucleic acid molecules encoding a u-PA protease provided.

As used herein, "synthetic," with reference to, for example, a synthetic nucleic acid molecule or a synthetic gene or a synthetic peptide refers to a nucleic acid molecule or polypeptide molecule that is produced by recombinant methods and/or by chemical synthesis methods.

As used herein, "polypeptide" refers to two or more amino acids covalently joined. The terms "polypeptide" and "protein" are used interchangeably herein.

As used herein, a "peptide" refers to a polypeptide that is from 2 to about or 40 amino acids in length.

As used herein, the amino acids which occur in the various sequences of amino acids provided herein are identified according to their known, three-letter or one-letter abbreviations (Table 2). The nucleotides which occur in the various nucleic acid fragments are designated with the standard single-letter designations used routinely in the art.

As used herein, an "amino acid" is an organic compound containing an amino group and a carboxylic acid group. A polypeptide contains two or more amino acids. For purposes herein, amino acids include the twenty naturally-occurring amino acids (Table 2), non-natural amino acids and amino acid analogs (i.e., amino acids where the α-carbon has a side chain). As used herein, the amino acids, which occur in the various amino acid sequences of polypeptides appearing herein, are identified according to their well-known, three-letter or one-letter abbreviations (see Table 2). The nucleotides, which occur in the various nucleic acid molecules and fragments, are designated with the standard single-letter designations used routinely in the art.

As used herein, "amino acid residue" refers to an amino acid formed upon chemical digestion (hydrolysis) of a polypeptide at its peptide linkages. The amino acid residues described herein are presumed to be in the "L" isomeric form. Residues in the "D" isomeric form, which are so designated, can be substituted for any L-amino acid residue as long as the desired functional property is retained by the polypeptide. NH$_2$ refers to the free amino group present at the amino terminus of a polypeptide. COOH refers to the free carboxy group present at the carboxyl terminus of a polypeptide. In keeping with standard polypeptide nomenclature described in *J. Biol. Chem.*, 243: 3557-3559 (1968), and adopted in 37 C.F.R. §§ 1.821-1.822, abbreviations for amino acid residues are shown in Table 2.

TABLE 2

Table of Correspondence

| SYMBOL | | |
|---|---|---|
| 1-Letter | 3-Letter | AMINO ACID |
| Y | Tyr | Tyrosine |
| G | Gly | Glycine |
| F | Phe | Phenylalanine |
| M | Met | Methionine |
| A | Ala | Alanine |
| S | Ser | Serine |
| I | Ile | Isoleucine |
| L | Leu | Leucine |
| T | Thr | Threonine |
| V | Val | Valine |
| P | Pro | Proline |
| K | Lys | Lysine |
| H | His | Histidine |
| Q | Gln | Glutamine |
| E | Glu | Glutamic acid |
| Z | Glx | Glu and/or Gln |
| W | Trp | Tryptophan |
| R | Arg | Arginine |
| D | Asp | Aspartic acid |
| N | Asn | Asparagine |
| B | Asx | Asn and/or Asp |
| C | Cys | Cysteine |
| X | Xaa | Unknown or other |

All sequences of amino acid residues represented herein by a formula have a left to right orientation in the conventional direction of amino-terminus to carboxyl-terminus. The phrase "amino acid residue" includes the amino acids listed in the Table of Correspondence (Table 2), modified, non-natural and unusual amino acids. Furthermore, a dash at the beginning or end of an amino acid residue sequence indicates a peptide bond to a further sequence of one or more amino acid residues or to an amino-terminal group such as NH$_2$ or to a carboxyl-terminal group such as COOH.

As used herein, "naturally occurring amino acids" refer to the 20 L-amino acids that occur in polypeptides. As used herein, the residues of naturally occurring α-amino acids are the residues of those 20 α-amino acids found in nature which are incorporated into protein by the specific recognition of the charged tRNA molecule with its cognate mRNA codon in humans.

As used herein, "non-natural amino acid" refers to an organic compound that has a structure similar to a natural amino acid but has been modified structurally to mimic the structure and reactivity of a natural amino acid. Non-naturally occurring amino acids thus include, for example, amino acids or analogs of amino acids other than the 20 naturally occurring amino acids and include, but are not limited to, the D-stereoisomers of amino acids. Exemplary non-natural amino acids are known to those of skill in the art, and include, but are not limited to, para-acetyl Phenylalanine, para-azido Phenylalanine, 2-Aminoadipic acid (Aad), 3-Aminoadipic acid (bAad), β-alanine/β-Amino-propionic acid (Bala), 2-Aminobutyric acid (Abu), 4-Aminobutyric acid/piperidinic acid (4Abu), 6-Aminocaproic acid (Acp), 2-Aminoheptanoic acid (Ahe), 2-Aminoisobutyric acid (Aib), 3-Aminoisobutyric acid (Baib), 2-Aminopimelic acid (Apm), 2,4-Diaminobutyric acid (Dbu), Desmosine (Des), 2,2'-Diaminopimelic acid (Dpm), 2,3-Diaminopropionic acid (Dpr), N-Ethylglycine (EtGly), N-Ethylasparagine (EtAsn), Hydroxylysine (Hyl), allo-Hydroxylysine (Ahyl), 3-Hydroxyproline (3Hyp), 4-Hydroxyproline (4Hyp), Isodesmosine (Ide), allo-Isoleucine (Aile), N-Methylglycine, sarcosine (MeGly), N-Methylisoleucine (MeIle), 6-N-Methyllysine (MeLys), N-Methylvaline (MeVal), Norvaline (Nva), Norleucine (Nle), and Ornithine (Orn). Exemplary non-natural amino acids are described herein and are known to those of skill in the art.

As used herein, an isokinetic mixture is one in which the molar ratios of amino acids has been adjusted based on their reported reaction rates (see, e.g., Ostresh et al. (1994) *Biopolymers* 34:1681).

As used herein, a DNA construct is a single or double stranded, linear or circular DNA molecule that contains segments of DNA combined and juxtaposed in a manner not found in nature. DNA constructs exist as a result of human manipulation, and include clones and other copies of manipulated molecules.

As used herein, a DNA segment is a portion of a larger DNA molecule having specified attributes. For example, a DNA segment encoding a specified polypeptide is a portion of a longer DNA molecule, such as a plasmid or plasmid fragment, which, when read from the 5' to 3' direction, encodes the sequence of amino acids of the specified polypeptide.

As used herein, the term ortholog means a polypeptide or protein obtained from one species that is the functional counterpart of a polypeptide or protein from a different species. Sequence differences among orthologs are the result of speciation.

As used herein, the term polynucleotide means a single- or double-stranded polymer of deoxyribonucleotides or ribonucleotide bases read from the 5' to the 3' end. Polynucleotides include RNA and DNA, and can be isolated from natural sources, synthesized in vitro, or prepared from a combination of natural and synthetic molecules. The length of a polynucleotide molecule is given herein in terms of nucleotides (abbreviated "nt") or base pairs (abbreviated "bp"). The term nucleotides is used for single- and double-stranded molecules where the context permits. When the term is applied to double-stranded molecules it is used to denote overall length and is understood to be equivalent to the term base pairs. Those skilled in the art understand that the two strands of a double-stranded polynucleotide can differ slightly in length and that the ends thereof can be staggered; thus all nucleotides within a double-stranded polynucleotide molecule cannot be paired. Such unpaired ends generally do not exceed 20 nucleotides in length.

As used herein, alignment of a sequence refers to the use of homology to align two or more sequences of nucleotides or amino acids. Typically, two or more sequences that are related by 50% or more identity are aligned. An aligned set of sequences refers to 2 or more sequences that are aligned at corresponding positions and can include aligning sequences derived from RNAs, such as ESTs and other cDNAs, aligned with genomic DNA sequences. Related or variant polypeptides or nucleic acid molecules can be aligned by any method known to those of skill in the art. Such methods typically maximize matches, and include methods, such as using manual alignments and by using the numerous alignment programs available (e.g., BLASTP) and others, known to those of skill in the art. By aligning the sequences of polypeptides or nucleic acids, one skilled in the art can identify analogous portions or positions, using conserved and identical amino acid residues as guides. Further, one skilled in the art also can employ conserved amino acid or nucleotide residues as guides to find corresponding amino acid or nucleotide residues between and among human and non-human sequences. Corresponding positions also can be based on structural alignments, for example by using computer simulated alignments of protein structure. In other instances, corresponding regions can be identified. One skilled in the art also can employ conserved amino acid residues as guides to find corresponding amino acid residues between and among human and non-human sequences.

As used herein, "sequence identity" refers to the number of identical or similar amino acids or nucleotide bases in a comparison between a test and a reference polypeptide or polynucleotide. Sequence identity can be determined by sequence alignment of nucleic acid or protein sequences to identify regions of similarity or identity. For purposes herein, sequence identity is generally determined by alignment to identify identical residues. The alignment can be local or global. Matches, mismatches and gaps can be identified between compared sequences. Gaps are null amino acids or nucleotides inserted between the residues of aligned sequences so that identical or similar characters are aligned. Generally, there can be internal and terminal gaps. Sequence identity can be determined by taking into account gaps as the number of identical residues/length of the shortest sequence×100. When using gap penalties, sequence identity can be determined with no penalty for end gaps (e.g. terminal gaps are not penalized). Alternatively, sequence identity can be determined without taking into account gaps as the number of identical positions/length of the total aligned sequence×100.

As used herein, "at a position corresponding to," or recitation that nucleotides or amino acid positions "correspond to" nucleotides or amino acid positions in a disclosed sequence, such as set forth in the Sequence listing, refers to nucleotides or amino acid positions identified upon alignment with the disclosed sequence to maximize identity using a standard alignment algorithm, such as the GAP algorithm. For purposes herein, alignment of a u-PA sequence is to the amino acid sequence of the protease domain of human u-PA set forth in SEQ ID NO: 2 or 5, particularly a reference human u-PA of SEQ ID NO:5. By aligning the sequences, one skilled in the art can identify corresponding residues, for example, using conserved and identical amino acid residues as guides. In general, to identify corresponding positions, the sequences of amino acids are aligned so that the highest order match is obtained (see, e.g.: *Computational Molecular Biology*, Lesk, A. M., ed., Oxford University Press, New York, 1988; *Biocomputing: Informatics and Genome Projects*, Smith, D. W., ed., Academic Press, New York, 1993;

*Computer Analysis of Sequence Data, Part I*, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M. and Devereux, J., eds., M Stockton Press, New York, 1991; and Carrillo et al. (1988) *SIAM J Applied Math* 48:1073-1082). Alternatively, the skilled person can number the residues by chymotrypsin number, thereby identify corresponding residues. For closely related sequences, a computer algorithm is not needed; alignment can be done visually.

As used herein, a "global alignment" is an alignment that aligns two sequences from beginning to end, aligning each letter in each sequence only once. An alignment is produced, regardless of whether or not there is similarity or identity between the sequences. For example, 50% sequence identity based on "global alignment" means that in an alignment of the full sequence of two compared sequences each of 100 nucleotides in length, 50% of the residues are the same. It is understood that global alignment also can be used in determining sequence identity even when the length of the aligned sequences is not the same. The differences in the terminal ends of the sequences are taken into account in determining sequence identity, unless the "no penalty for end gaps" is selected. Generally, a global alignment is used on sequences that share significant similarity over most of their length. Exemplary algorithms for performing global alignment include the Needleman-Wunsch algorithm (Needleman et al. (1970) *J. Mol. Biol.* 48: 443). Exemplary programs for performing global alignment are publicly available and include the Global Sequence Alignment Tool available at the National Center for Biotechnology Information (NCBI) website (ncbi.nlm.nih.gov/), and the program available at deepc2.psi.iastate.edu/aat/align/align.html.

As used herein, a "local alignment" is an alignment that aligns two sequences, but only aligns those portions of the sequences that share similarity or identity. Hence, a local alignment determines if sub-segments of one sequence are present in another sequence. If there is no similarity, no alignment is returned. Local alignment algorithms include BLAST and Smith-Waterman algorithm (*Adv. Appl. Math.* 2: 482 (1981)). For example, 50% sequence identity based on "local alignment" means that in an alignment of the full sequence of two compared sequences of any length, a region of similarity or identity of 100 nucleotides in length has 50% of the residues that are the same in the region of similarity or identity.

For purposes herein, sequence identity can be determined by standard alignment algorithm programs used with default gap penalties established by each supplier. Default parameters for the GAP program can include: (1) a unary comparison matrix (containing a value of 1 for identities and 0 for non identities) and the weighted comparison matrix of Gribskov et al. (1986) *Nucl. Acids Res.* 14: 6745, as described by Schwartz and Dayhoff, eds., *Atlas of Protein Sequence and Structure*, National Biomedical Research Foundation, pp. 353-358 (1979); (2) a penalty of 3.0 for each gap and an additional 0.10 penalty for each symbol in each gap; and (3) no penalty for end gaps. Whether any two nucleic acid molecules have nucleotide sequences or any two polypeptides have amino acid sequences that are at least 80%, 85%, 90%, 95%, 96%, 97%, 98% or 99% "identical," or other similar variations reciting a percent identity, can be determined using known computer algorithms based on local or global alignment (see, e.g., wikipedia.org/wiki/Sequence_alignment_software, providing links to dozens of known and publicly available alignment databases and programs). Generally, for purposes herein sequence identity is determined using computer algorithms based on global alignment, such as the Needleman-Wunsch Global Sequence Alignment tool available from NCBI/BLAST (blast.ncbi.nlm.nih.gov/Blast.cgi?CMD=Web&Page_TYPE=BlastHome); LAlign (William Pearson implementing the Huang and Miller algorithm (*Adv. Appl. Math.* (1991) 12:337-357)); and program from Xiaoqui Huang available at deepc2.psi.iastate.edu/aat/align/align.html. Generally, when comparing nucleotide sequences herein, an alignment with penalty for end gaps is used. Local alignment also can be used when the sequences being compared are substantially the same length.

As used herein, the term "identity" represents a comparison or alignment between a test and a reference polypeptide or polynucleotide. In one non-limiting example, "at least 90% identical to" refers to percent identities from 90% to 100% relative to the reference polypeptide or polynucleotide. Identity at a level of 90% or more is indicative of the fact that, assuming for exemplification purposes a test and reference polypeptide or polynucleotide length of 100 amino acids or nucleotides are compared, no more than 10% (i.e., 10 out of 100) of amino acids or nucleotides in the test polypeptide or polynucleotide differs from that of the reference polypeptides. Similar comparisons can be made between a test and reference polynucleotides. Such differences can be represented as point mutations randomly distributed over the entire length of an amino acid sequence or they can be clustered in one or more locations of varying length up to the maximum allowable, e.g., 10/100 amino acid difference (approximately 90% identity). Differences also can be due to deletions or truncations of amino acid residues. Differences are defined as nucleic acid or amino acid substitutions, insertions or deletions. Depending on the length of the compared sequences, at the level of homologies or identities above about 85-90%, the result can be independent of the program and gap parameters set; such high levels of identity can be assessed readily, often without relying on software.

As used herein, a disulfide bond (also called an S—S bond or a disulfide bridge) is a single covalent bond derived from the coupling of thiol groups. Disulfide bonds in proteins are formed between the thiol groups of cysteine residues, and stabilize interactions between polypeptide domains.

As used herein, "coupled" or "conjugated" means attached via a covalent or noncovalent interaction. Conjugates provided herein, contain a modified u-PA polypeptide protease domain (referred to as a "SPD," see, e.g., FIG. 4), and all or portion of the remaining u-PA polypeptide, linked directly or vial a linker to another moiety, such as a polypeptide that confers a property, such as increased serum half life (i.e., human serum albumin HSA), or facilitates expression or purification (i.e., SUMO, his-SUMO, TSG-6), or targets the protein to receptor, such as an antibody that binds to a receptor. The polypeptide can be linked directly or via a polypeptide linker, generally a short, about 4-20, amino acids, such as combinations of Ser and Gly residues. Conjugates that contain a polypeptide generally are fusion proteins. Conjugates also include modified u-PA polypeptides in which amino acid residues are linked to moieties, such as PEG moieties, glycosylation moieties and other such moieties.

As used herein, "primer" refers to a nucleic acid molecule that can act as a point of initiation of template-directed DNA synthesis under appropriate conditions (e.g., in the presence of four different nucleoside triphosphates and a polymerization agent, such as DNA polymerase, RNA polymerase or reverse transcriptase) in an appropriate buffer and at a suitable temperature. The skilled person understands that certain nucleic acid molecules can serve as a "probe" and as a "primer." A primer, however, has a 3' hydroxyl group for extension. A primer can be used in a variety of methods, including, for example, polymerase chain reaction (PCR), reverse-transcriptase (RT)-PCR, RNA PCR, LCR, multiplex PCR, panhandle PCR, capture PCR, expression PCR, 3' and 5' RACE, in situ PCR, ligation-mediated PCR and other amplification protocols.

As used herein, "primer" refers to an oligonucleotide containing two or more deoxyribonucleotides or ribonucleotides, typically more than three, from which synthesis of a primer extension product can be initiated. Experimental conditions conducive to synthesis include the presence of nucleoside triphosphates and an agent for polymerization and extension, such as DNA polymerase, and a suitable buffer, temperature and pH.

As used herein, "primer pair" refers to a set of primers that includes a 5' (upstream) primer that hybridizes with the 5' end of a sequence to be amplified (e.g. by PCR) and a 3' (downstream) primer that hybridizes with the complement of the 3' end of the sequence to be amplified.

As used herein, "specifically hybridizes" refers to annealing, by complementary base-pairing, of a nucleic acid molecule (e.g. an oligonucleotide) to a target nucleic acid molecule. Those of skill in the art are familiar with in vitro and in vivo parameters that affect specific hybridization, such as length and composition of the particular molecule. Parameters particularly relevant to in vitro hybridization further include annealing and washing temperature, buffer composition and salt concentration. Exemplary washing conditions for removing non-specifically bound nucleic acid molecules at high stringency are 0.1×SSPE, 0.1% SDS, 65° C., and at medium stringency are 0.2×SSPE, 0.1% SDS, 50° C. Equivalent stringency conditions are known in the art. The skilled person can readily adjust these parameters to achieve specific hybridization of a nucleic acid molecule to a target nucleic acid molecule appropriate for a particular application.

As used herein, substantially identical to a product means sufficiently similar so that the property of interest is sufficiently unchanged so that the substantially identical product can be used in place of the product.

As used herein, it also is understood that the terms "substantially identical" or "similar" varies with the context as understood by those skilled in the relevant art.

As used herein, the wild-type form of a polypeptide or nucleic acid molecule is a form encoded by a gene or by a coding sequence encoded by the gene. Typically, a wild-type form of a gene, or molecule encoded thereby, does not contain mutations or other modifications that alter function or structure. The term wild-type also encompasses forms with allelic variation as occurs among and between species. As used herein, a predominant form of a polypeptide or nucleic acid molecule refers to a form of the molecule that is the major form produced from a gene. A "predominant form" varies from source to source. For example, different cells or tissue types can produce different forms of polypeptides, for example, by alternative splicing and/or by alternative protein processing. In each cell or tissue type, a different polypeptide can be a "predominant form."

As used herein, an allelic variant or allelic variation references any of two or more alternative forms of a gene occupying the same chromosomal locus. Allelic variation arises naturally through mutation, and can result in phenotypic polymorphism within populations. Gene mutations can be silent (no change in the encoded polypeptide) or can encode polypeptides having altered amino acid sequence. The term "allelic variant" also is used herein to denote a protein encoded by an allelic variant of a gene. Typically the reference form of the gene encodes a wild type form and/or predominant form of a polypeptide from a population or single reference member of a species. Typically, allelic variants, which include variants between and among species, have at least 80%, 90% or greater amino acid identity with a wild-type and/or predominant form from the same species; the degree of identity depends upon the gene and whether comparison is interspecies or intraspecies. Generally, intraspecies allelic variants have at least or at least about 80%, 85%, 90% or 95% identity or greater with a wild type and/or predominant form, including at least or at least about 96%, 97%, 98%, 99% or greater identity with a wild-type and/or predominant form of a polypeptide.

As used herein, "allele," which is used interchangeably herein with "allelic variant" refers to alternative forms of a gene or portions thereof. Alleles occupy the same locus or position on homologous chromosomes. When a subject has two identical alleles of a gene, the subject is said to be homozygous for that gene or allele. When a subject has two different alleles of a gene, the subject is said to be heterozygous for the gene. Alleles of a specific gene can differ from each other in a single nucleotide or several nucleotides, and can include substitutions, deletions and insertions of nucleotides. An allele of a gene also can be a form of a gene containing a mutation.

As used herein, species variants refer to variants in polypeptides among different species, including different mammalian species, such as mouse and human. Generally, species variants have about or 70%, 75%, 80%, 85%, 90%, 91%, 92%, 93%, 94%, 95%, 96%, 97%, 98% or 99% or more sequence identity. Corresponding residues between and among species variants can be determined by comparing and aligning sequences to maximize the number of matching nucleotides or residues, for example, such that identity between the sequences is equal to or greater than 95%, equal to or greater than 96%, equal to or greater than 97%, equal to or greater than 98% or equal to greater than 99%. The position of interest is then given the number assigned in the reference nucleic acid molecule. Alignment can be effected manually or by eye, particularly, where sequence identity is greater than 80%.

As used herein, a splice variant refers to a variant produced by differential processing of a primary transcript of genomic DNA that results in more than one type of mRNA.

As used herein, modification in reference to modification of the primary sequence of amino acids of a polypeptide or a sequence of nucleotides in a nucleic acid molecule and includes deletions, insertions, and replacements of amino acids and nucleotides, respectively. This in contrast to modifications of the polypeptide itself, which include post-translational modifications, such as glycosylation, farnysylation, pegylation, and fusions, such as fusions with other polypeptides to change a property, such as serum half-life, such as by albumination, fusion with albumin, such as human serum albumin, and other such modifications to the polypeptide. Thus reference to modifications of the sequence of amino acids refers to insertions, deletions, substitutions/replacements, and combinations thereof. Modification of the polypeptide refers to modifications that are added to the polypeptide that do not change the sequence thereof.

For purposes herein, amino acid substitutions, deletions and/or insertions, can be made in any of u-PA polypeptide or catalytically active fragment thereof provided that the resulting protein exhibits protease activity or other activity (or, if desired, such changes can be made to eliminate activity). Modifications can be made by making conservative amino acid substitutions and also non-conservative amino acid substitutions. For example, amino acid substitutions that desirably or advantageously alter properties of the proteins can be made. In one embodiment, mutations that prevent degradation of the polypeptide can be made. Many proteases cleave after basic residues, such as R and K; to eliminate such cleavage, the basic residue is replaced with a non-basic residue. Interaction of the protease with an inhibitor can be blocked while retaining catalytic activity by effecting a non-conservative change at the site of interaction of the inhibitor with the protease. Other activities also can be altered. For example, receptor binding can be altered without altering catalytic activity.

Amino acid substitutions contemplated include conservative substitutions, such as those set forth in Table 3, which do not eliminate proteolytic activity. As described herein, substitutions that alter properties of the proteins, such as removal of cleavage sites and other such sites also are contemplated; such substitutions are generally non-conservative, but can be readily effected by those of skill in the art.

As used herein, suitable conservative substitutions of amino acids are known to those of skill in this art and can be made generally without altering the biological activity of the resulting molecule. Those of skill in this art recognize that, in general, single amino acid substitutions in non-essential regions of a polypeptide do not substantially alter biological activity (see, e.g., Watson et al. Molecular Biology of the Gene, 4th Edition, 1987, The Benjamin/Cummings Pub. Co., p. 224). Such substitutions can be made in accordance with those set forth in Table 3 as follows:

TABLE 3

| Original residue | Exemplary conservative substitution |
| --- | --- |
| Ala (A) | Gly; Ser |
| Arg (R) | Lys |
| Asn (N) | Gln; His |
| Cys (C) | Ser |
| Gln (Q) | Asn |
| Glu (E) | Asp |
| Gly (G) | Ala; Pro |
| His (H) | Asn; Gln |
| Ile (I) | Leu; Val |
| Leu (L) | Ile; Val |
| Lys (K) | Arg; Gln; Glu |
| Met (M) | Leu; Tyr; Ile |
| Phe (F) | Met; Leu; Tyr |
| Ser (S) | Thr |
| Thr (T) | Ser |
| Trp (W) | Tyr |
| Tyr (Y) | Trp; Phe |
| Val (V) | Ile; Leu |

Other substitutions also are permissible and can be determined empirically or in accord with known conservative substitutions.

As used herein, the term promoter means a portion of a gene containing DNA sequences that provide for the binding of RNA polymerase and initiation of transcription. Promoter sequences are commonly, but not always, found in the 5' non-coding region of genes.

As used herein, isolated or purified polypeptide or protein or biologically-active portion thereof is substantially free of cellular material or other contaminating proteins from the cell of tissue from which the protein is derived, or substantially free from chemical precursors or other chemicals when chemically synthesized. Preparations can be determined to be substantially free if they appear free of readily detectable impurities as determined by standard methods of analysis, such as thin layer chromatography (TLC), gel electrophoresis and high performance liquid chromatography (HPLC), used by those of skill in the art to assess such purity, or sufficiently pure such that further purification would not detectably alter the physical and chemical properties, such as enzymatic and biological activities, of the substance. Methods for purification of the compounds to produce substantially chemically pure compounds are known to those of skill in the art. A substantially chemically pure compound, however, can be a mixture of stereoisomers. In such instances, further purification might increase the specific activity of the compound.

The term substantially free of cellular material includes preparations of proteins in which the protein is separated from cellular components of the cells from which it is isolated or recombinantly-produced. In one embodiment, the term substantially free of cellular material includes preparations of protease proteins having less that about 30% (by dry weight) of non-protease proteins (also referred to herein as a contaminating protein), generally less than about 20% of non-protease proteins or 10% of non-protease proteins or less that about 5% of non-protease proteins. When the protease protein or active portion thereof is recombinantly produced, it also is substantially free of culture medium, i.e., culture medium represents less than, about, or equal to 20%, 10% or 5% of the volume of the protease protein preparation.

As used herein, the term substantially free of chemical precursors or other chemicals includes preparations of protease proteins in which the protein is separated from chemical precursors or other chemicals that are involved in the synthesis of the protein. The term includes preparations of protease proteins having less than about 30% (by dry weight), 20%, 10%, 5% or less of chemical precursors or non-protease chemicals or components.

As used herein, production by recombinant means by using recombinant DNA methods refers to the use of the well known methods of molecular biology for expressing proteins encoded by cloned DNA.

As used herein, "expression" refers to the process by which polypeptides are produced by transcription and translation of polynucleotides. The level of expression of a polypeptide can be assessed using any method known in art, including, for example, methods of determining the amount of the polypeptide produced from the host cell. Such methods can include, but are not limited to, quantitation of the polypeptide in the cell lysate by ELISA, Coomassie blue staining following gel electrophoresis, Lowry protein assay and Bradford protein assay.

As used herein, a "host cell" is a cell that is used to receive, maintain, reproduce and/or amplify a vector. Host cells also can be used to express the polypeptide encoded by the vector. The nucleic acid contained in the vector is replicated when the host cell divides, thereby amplifying the nucleic acids.

As used herein, a "vector" or "plasmid" is a replicable nucleic acid from which one or more heterologous proteins can be expressed when the vector is transformed into an appropriate host cell. Reference to a vector includes discrete elements that are used to introduce heterologous nucleic acid into cells for either expression or replication thereof. Reference to a vector also includes those vectors into which a nucleic acid encoding a polypeptide or fragment thereof can be introduced, typically by restriction digest and ligation.

Reference to a vector also includes those vectors that contain nucleic acid encoding a protease, such as a modified u-PA. The vector is used to introduce the nucleic acid encoding the polypeptide into the host cell for amplification of the nucleic acid or for expression/display of the polypeptide encoded by the nucleic acid. The vectors typically remain episomal, but can be designed to effect integration of a gene or portion thereof into a chromosome of the genome. Also contemplated are vectors that are artificial chromosomes, such as yeast artificial chromosomes and mammalian artificial chromosomes. Selection and use of such vehicles are well-known to those of skill in the art. A vector also includes "virus vectors" or "viral vectors." Viral vectors are engineered viruses that are operatively linked to exogenous genes to transfer (as vehicles or shuttles) the exogenous genes into cells.

As used herein, an "expression vector" includes vectors capable of expressing DNA that is operatively linked with regulatory sequences, such as promoter regions, that are capable of effecting expression of such DNA fragments. Such additional segments can include promoter and terminator sequences, and optionally can include one or more origins of replication, one or more selectable markers, an enhancer, a polyadenylation signal, and the like. Expression vectors are generally derived from plasmid or viral DNA, or can contain elements of both. Thus, an expression vector refers to a recombinant DNA or RNA construct, such as a plasmid, a phage, recombinant virus or other vector that, upon introduction into an appropriate host cell, results in expression of the cloned DNA. Appropriate expression vectors are well known to those of skill in the art and include those that are replicable in eukaryotic cells and/or prokaryotic cells and those that remain episomal or those which integrate into the host cell genome.

As used herein, vector also includes "virus vectors" or "viral vectors." Viral vectors are engineered viruses that are operatively linked to exogenous genes to transfer (as vehicles or shuttles) the exogenous genes into cells.

As used herein, an adenovirus refers to any of a group of DNA-containing viruses that cause conjunctivitis and upper respiratory tract infections in humans. As used herein, naked DNA refers to histone-free DNA that can be used for vaccines and gene therapy. Naked DNA is the genetic material that is passed from cell to cell during a gene transfer processed called transformation. In transformation, purified or naked DNA is taken up by the recipient cell which will give the recipient cell a new characteristic or phenotype.

As used herein, "operably linked" with reference to nucleic acid sequences, regions, elements or domains means that the nucleic acid regions are functionally related to each other. For example, nucleic acid encoding a leader peptide can be operably linked to nucleic acid encoding a polypeptide, whereby the nucleic acids can be transcribed and translated to express a functional fusion protein, where the leader peptide effects secretion of the fusion polypeptide. In some instances, the nucleic acid encoding a first polypeptide (e.g., a leader peptide) is operably linked to nucleic acid encoding a second polypeptide and the nucleic acids are transcribed as a single mRNA transcript, but translation of the mRNA transcript can result in one of two polypeptides being expressed. For example, an amber stop codon can be located between the nucleic acid encoding the first polypeptide and the nucleic acid encoding the second polypeptide, such that, when introduced into a partial amber suppressor cell, the resulting single mRNA transcript can be translated to produce either a fusion protein containing the first and second polypeptides, or can be translated to produce only the first polypeptide. In another example, a promoter can be operably linked to nucleic acid encoding a polypeptide, whereby the promoter regulates or mediates the transcription of the nucleic acid.

As used herein, "primary sequence" refers to the sequence of amino acid residues in a polypeptide or the sequence of nucleotides in a nucleic acid molecule.

As used herein, protein binding sequence refers to a protein or peptide sequence that is capable of specific binding to other protein or peptide sequences generally, to a set of protein or peptide sequences or to a particular protein or peptide sequence.

As used herein, a "tag" or an "epitope tag" refers to a sequence of amino acids, typically added to the N- or C-terminus of a polypeptide, such as a u-PA provided herein. The inclusion of tags fused to a polypeptide can facilitate polypeptide purification and/or detection. Typically, a tag or tag polypeptide refers to a polypeptide that has enough residues to provide an epitope recognized by an antibody or can serve for detection or purification, yet is short enough such that it does not interfere with activity of the polypeptide to which it is linked. The tag polypeptide typically is sufficiently unique so that an antibody that specifically binds thereto does not substantially cross-react with epitopes in the polypeptide to which it is linked. Epitope tagged proteins can be affinity purified using highly specific antibodies raised against the tags.

Suitable tag polypeptides generally have at least 5 or 6 amino acid residues and usually between about 8-50 amino acid residues, typically between 9-30 residues. The tags can be linked to one or more proteins and permit detection of the protein or its recovery from a sample or mixture. Such tags are well-known and can be readily synthesized and designed. Exemplary tag polypeptides include those used for affinity purification and include, Small Ubiquitin-like Modifier (SUMO) tags, FLAG tags, His tags, the influenza hemagglutinin (HA) tag polypeptide and its antibody 12CA5, (Field et al. (1988) *Mol. Cell. Biol.* 8:2159-2165); the c-myc tag and the 8F9, 3C7, 6E10, G4, B7 and 9E10 antibodies thereto (see, e.g., Evan et al. (1985) *Molecular and Cellular Biology* 5:3610-3616); and the Herpes Simplex virus glycoprotein D (gD) tag and its antibody (Paborsky et al. (1990) *Protein Engineering* 3:547-553). An antibody used to detect an epitope-tagged antibody is typically referred to herein as a secondary antibody.

As used herein, metal binding sequence refers to a protein or peptide sequence that is capable of specific binding to metal ions generally, to a set of metal ions or to a particular metal ion.

As used herein the term assessing is intended to include quantitative and qualitative determination in the sense of obtaining an absolute value for the activity of a protease, or a domain thereof, present in the sample, and also of obtaining an index, ratio, percentage, visual or other value indicative of the level of the activity. Assessment can be direct or indirect and the chemical species actually detected need not of course be the proteolysis product itself but can, for example, be a derivative thereof or some further substance. For example, detection of a cleavage product of a complement protein, such as by SDS-PAGE and protein staining with Coomassie blue.

As used herein, biological activity refers to the in vivo activities of a compound or physiological responses that result upon in vivo administration of a compound, composition or other mixture. Biological activity, thus, encompasses therapeutic effects and pharmaceutical activity of such compounds, compositions and mixtures. Biological activities can be observed in in vitro systems designed to test or use such activities. Thus, for purposes herein a biological activity of a protease is its catalytic activity in which a polypeptide is hydrolyzed.

As used herein, equivalent, when referring to two sequences of nucleic acids, means that the two sequences in question encode the same sequence of amino acids or equivalent proteins. When equivalent is used in referring to two proteins or peptides, it means that the two proteins or peptides have substantially the same amino acid sequence with only amino acid substitutions (such as, but not limited to, conservative changes such as those set forth in Table 3, above) that do not substantially alter the activity or function of the protein or peptide. When equivalent refers to a property, the property does not need to be present to the same extent (e.g., two peptides can exhibit different rates of the same type of enzymatic activity), but the activities are usually substantially the same. Complementary, when referring to two nucleotide sequences, means that the two sequences of nucleotides are capable of hybridizing, typically with less than 25%, 15% or 5% mismatches between opposed nucleotides. If necessary, the percentage of complementarity will be specified. Typically the two molecules are selected such that they will hybridize under conditions of high stringency.

As used herein, an agent that modulates the activity of a protein or expression of a gene or nucleic acid either decreases or increases or otherwise alters the activity of the protein or, in some manner, up- or down-regulates or otherwise alters expression of the nucleic acid in a cell.

As used herein, a "chimeric protein" or "fusion protein" protease refers to a polypeptide operatively-linked to a different polypeptide. A chimeric or fusion protein provided herein can include one or more proteases or a portion thereof, such as single chain protease domains thereof, and one or more other polypeptides for any one or more of a transcriptional/translational control signals, signal sequences, a tag for localization, a tag for purification, part of a domain of an immunoglobulin G, and/or a targeting agent. These chimeric or fusion proteins include those produced by recombinant means as fusion proteins, those produced by chemical means, such as by chemical coupling, through, for example, coupling to sulfhydryl groups, and those produced by any other method whereby at least one protease, or a portion thereof, is linked, directly or indirectly via linker(s) to another polypeptide.

As used herein, operatively-linked when referring to a fusion protein refers to a protease polypeptide and a non-protease polypeptide that are fused in-frame to one another. The non-protease polypeptide can be fused to the N-terminus or C-terminus of the protease polypeptide.

As used herein, a targeting agent is any moiety, such as a protein or effective portion thereof, that provides specific binding of the conjugate to a cell surface receptor, which in some instances can internalize bound conjugates or portions thereof. A targeting agent also can be one that promotes or facilitates, for example, affinity isolation or purification of the conjugate; attachment of the conjugate to a surface; or detection of the conjugate or complexes containing the conjugate.

As used herein, "linker" refers to short sequences of amino acids that join two polypeptides (or nucleic acid encoding such polypeptides). "Peptide linker" refers to the short sequence of amino acids joining the two polypeptide sequences. Exemplary of polypeptide linkers are linkers joining two antibody chains in a synthetic antibody fragment such as an scFv fragment. Linkers are well-known and any known linkers can be used in the provided methods. Exemplary of polypeptide linkers are (Gly-Ser)$_n$ amino acid sequences, with some Glu or Lys residues dispersed throughout to increase solubility. Other exemplary linkers are described herein; any of these and other known linkers can be used with the provided compositions and methods.

As used herein, derivative or analog of a molecule refers to a portion derived from or a modified version of the molecule.

As used herein, "disease or disorder" refers to a pathological condition in an organism resulting from cause or condition including, but not limited to, infections, acquired conditions, genetic conditions, conditions related to environmental exposures and human behaviors, and conditions characterized by identifiable symptoms. Diseases or disorders include clinically diagnosed disease as well as disruptions in the normal state of the organism that have not been diagnosed as clinical disease. Diseases and disorders of interest herein are those involving complement activation, including those mediated by complement activation and those in which complement activation plays a role in the etiology or pathology. Diseases and disorders of interest herein include those characterized by complement activation (e.g., age-related macular degeneration and renal delayed graft function).

As used herein, macular degeneration occurs when the small central portion of the retina, known as the macula, deteriorates. There are two types of AMD: dry (atrophic) and wet (neovascular or exudative). Most AMD starts as the dry type and in $10^{-20}$% of individuals, it progresses to the wet type. Age-related macular degeneration is always bilateral (i.e., occurs in both eyes), but does not necessarily progress at the same pace in both eyes.

As used herein, age-related macular degeneration (AMD) is an inflammatory disease that causes visual impairment and blindness in older people. The proteins of the complement system are central to the development of this disease. Local and systemic inflammation in AMD are mediated by the deregulated action of the alternative pathway of the complement system.

As used herein, delayed graft function (DGF) is a manifestation of acute kidney injury (AKI) with attributes unique to the transplant process. It occurs post-transplant surgery. Delayed graft function (DGF) is a common complication frequently defined as the need for dialysis during the first post transplant week. Intrinsic renal synthesis of the third complement component C3 (C3) contributes to acute rejection by priming a T-cell-mediated response. For example, in brain dead donors, local renal C3 levels are higher at procurement and inversely related to renal function 14 days after transplant.

As used herein, a complement-mediated disease or disorder is any disorder in which any one or more of the complement proteins plays a role in the disease, either due to an absence or presence of a complement protein or complement-related protein or activation or inactivation of a complement or complement-related protein. In some embodiments, a complement-mediated disorder is one that is due to a deficiency in a complement protein(s). In other embodiments as described herein a complement-mediated disorder is one that is due to activation or over-activation of a complement protein(s). A complement-mediated disorder also is one that is due to the presence of any one or more of the complement proteins and/or the continued activation of the complement pathway.

As used herein, "macular degeneration-related disorder" refers to any of a number of conditions in which the retinal macula degenerates or becomes dysfunctional (e.g., as a consequence of decreased growth of cells of the macula, increased death or rearrangement of the cells of the macula (e.g., RPE cells), loss of normal biological function, or a combination of these events). Macular degeneration results in the loss of integrity of the histoarchitecture of the cells and/or extracellular matrix of the normal macula and/or the loss of function of the cells of the macula. Examples of macular degeneration-related disorder include age-related macular degeneration (AMD), geographic atrophy (GA), North Carolina macular dystrophy, Sorsby's fundus dystrophy, Stargardt's disease, pattern dystrophy, Best disease, dominant drusen, and malattia leventinese (radial drusen). Macular degeneration-related disorder also encompasses extramacular changes that occur prior to, or following dysfunction and/or degeneration of the macula. Thus, the term "macular degeneration-related disorder" also broadly includes any condition which alters or damages the integrity or function of the macula (e.g., damage to the RPE or Bruch's membrane). For example, the term encompasses retinal detachment, chorioretinal degenerations, retinal degenerations, photoreceptor degenerations, RPE degenerations, mucopolysaccharidoses, rod-cone dystrophies, cone-rod dystrophies and cone degenerations.

A macular degeneration-related disorder described herein includes macular degeneration, such as, for example, AMD macular degeneration. A macular degeneration-related disorder includes disorders treated by anti-VEGF treatment, such as, for example, anti-VEGF antibodies, or laser treatment or an implantable telescope.

As used herein, "treating" a subject with a disease or condition means that the subject's symptoms are partially or totally alleviated, or remain static following treatment. Hence treatment encompasses prophylaxis, therapy and/or cure. Prophylaxis refers to prevention of a potential disease and/or a prevention of worsening of symptoms or progression of a disease. Treatment also encompasses any pharmaceutical use of a modified u-PA polypeptide and compositions provided herein.

As used herein, "prevention" or "prophylaxis" refers to methods in which the risk or probability of developing a disease or condition is reduced.

As used herein, a "therapeutic agent," "therapeutic regimen," "radioprotectant," or "chemotherapeutic" mean conventional drugs and drug therapies, including vaccines, which are known to those skilled in the art. Radiotherapeutic agents are well known in the art.

As used herein, "treatment" means any manner in which the symptoms of a condition, disorder or disease are ameliorated or otherwise beneficially altered. Treatment also encompasses any pharmaceutical use of the compositions herein.

As used herein, "amelioration of the symptoms" of a particular disease or disorder by a treatment, such as by administration of a pharmaceutical composition or other therapeutic, refers to any lessening, whether permanent or temporary, lasting or transient, of the symptoms that can be attributed to or associated with administration of the composition or therapeutic.

As used herein, a "pharmaceutically effective agent" includes any therapeutic agent or bioactive agents, including, but not limited to, for example, anesthetics, vasoconstrictors, dispersing agents, and conventional therapeutic drugs, including small molecule drugs and therapeutic proteins.

As used herein an "effective amount" of a compound or composition for treating a particular disease is an amount that is sufficient to ameliorate, or in some manner reduce the symptoms associated with the disease. Such amount can be administered as a single dosage or can be administered according to a regimen, whereby it is effective. The amount can cure the disease but, typically, is administered in order to ameliorate the symptoms of the disease. Typically, repeated administration is required to achieve a desired amelioration of symptoms.

As used herein, a "therapeutically effective amount" or a "therapeutically effective dose" refers to the quantity of an agent, compound, material, or composition containing a compound that is at least sufficient to produce a therapeutic effect following administration to a subject. Hence, it is the quantity necessary for preventing, curing, ameliorating, arresting or partially arresting a symptom of a disease or disorder.

As used herein, a "therapeutic effect" means an effect resulting from treatment of a subject that alters, typically improves or ameliorates, the symptoms of a disease or condition or that cures a disease or condition.

As used herein, a "prophylactically effective amount" or a "prophylactically effective dose" refers to the quantity of an agent, compound, material, or composition containing a compound that when administered to a subject, have the intended prophylactic effect, e.g., preventing or delaying the onset, or reoccurrence, of disease or symptoms, reducing the likelihood of the onset, or reoccurrence, of disease or symptoms, or reducing the incidence of viral infection. The full prophylactic effect does not necessarily occur by administration of one dose, and can occur only after administration of a series of doses. Thus, a prophylactically effective amount can be administered in one or more administrations.

As used herein, "administration of a non-complement protease", such as a modified u-PA protease, refers to any method in which the non-complement protease is contacted with its substrate. Administration can be effected in vivo or ex vivo or in vitro. For example, for ex vivo administration a body fluid, such as blood, is removed from a subject and contacted outside the body with the modified non-complement protease, such as a modified u-PA protease. For in vivo administration, the modified non-complement protease, such as a modified u-PA protease, can be introduced into the body, such as by local, topical, systemic and/or other route of introduction. In vitro administration encompasses methods, such as cell culture methods.

As used herein, "unit dose form" refers to physically discrete units suitable for human and animal subjects and packaged individually as is known in the art.

As used herein, "patient" or "subject" to be treated includes humans and human or non-human animals. Mammals include; primates, such as humans, chimpanzees, gorillas and monkeys; domesticated animals, such as dogs, horses, cats, pigs, goats and cows; and rodents such as mice, rats, hamsters and gerbils.

As used herein, a "combination" refers to any association between or among two or more items. The association can be spatial or refer to the use of the two or more items for a common purpose. The combination can be two or more separate items, such as two compositions or two collections, a mixture thereof, such as a single mixture of the two or more items, or any variation thereof. The elements of a combination are generally functionally associated or related.

As used herein, a "composition" refers to any mixture of two or more products or compounds (e.g., agents, modulators, regulators, etc.). It can be a solution, a suspension, liquid, powder, a paste, aqueous or non-aqueous formulations or any combination thereof.

As used herein, a stabilizing agent refers to compound added to the formulation to protect either the antibody or conjugate, such as under the conditions (e.g. temperature) at which the formulations herein are stored or used. Thus, included are agents that prevent proteins from degradation from other components in the compositions. Exemplary of such agents are amino acids, amino acid derivatives, amines, sugars, polyols, salts and buffers, surfactants, inhibitors or substrates and other agents as described herein.

As used herein, "fluid" refers to any composition that can flow. Fluids thus encompass compositions that are in the form of semi-solids, pastes, solutions, aqueous mixtures, gels, lotions, creams and other such compositions.

As used herein, an "article of manufacture" is a product that is made and sold. As used throughout this application, the term is intended to encompass a therapeutic agent with a modified u-PA polypeptide or nucleic acid molecule contained in the same or separate articles of packaging.

As used herein, a "kit" refers to a packaged combination, optionally including reagents and other products and/or components for practicing methods using the elements of the combination. For example, kits containing a modified protease polypeptide, such as a modified u-PA protease provided herein, or nucleic acid molecule provided herein and another item for a purpose including, but not limited to, administration, diagnosis, and assessment of a biological activity or property are provided. Kits optionally include instructions for use.

As used herein, a "cellular extract" refers to a preparation or fraction which is made from a lysed or disrupted cell.

As used herein, "animal" includes any animal, such as, but not limited to; primates including humans, gorillas and monkeys; rodents, such as mice and rats; fowl, such as chickens; ruminants, such as goats, cows, deer, sheep; porcine, such as pigs and other animals. Non-human animals exclude humans as the contemplated animal. The proteases provided herein are from any source, animal, plant, prokaryotic and fungal. Most proteases are of animal origin, including mammalian origin.

As used herein, a "single dosage" formulation refers to a formulation containing a single dose of therapeutic agent for direct administration. Single dosage formulations generally do not contain any preservatives.

As used herein, a multi-dose formulation refers to a formulation that contains multiple doses of a therapeutic agent and that can be directly administered to provide several single doses of the therapeutic agent. The doses can be administered over the course of minutes, hours, weeks, days or months. Multi-dose formulations can allow dose adjustment, dose-pooling and/or dose-splitting. Because multi-dose formulations are used over time, they generally contain one or more preservatives to prevent microbial growth.

As used herein, a "control" or "standard" refers to a sample that is substantially identical to the test sample, except that it is not treated with a test parameter, or, if it is a plasma sample, it can be from a normal volunteer not affected with the condition of interest. A control also can be an internal control. For example, a control can be a sample, such as a virus, that has a known property or activity.

As used herein, the singular forms "a," "an" and "the" include plural referents unless the context clearly dictates otherwise. Thus, for example, reference to "an" agent includes one or more agents.

As used herein, the term "or" is used to mean "and/or" unless explicitly indicated to refer to alternatives only or if the alternatives are mutually exclusive.

As used herein, ranges and amounts can be expressed as "about" a particular value or range. About also includes the exact amount. Hence "about 5 bases" means "about 5 bases" and also "5 bases."

As used herein, "optional" or "optionally" means that the subsequently described event or circumstance does or does not occur, and that the description includes instances where said event or circumstance occurs and instances where it does not. For example, an optionally substituted group means that the group is unsubstituted or is substituted.

As used herein, the abbreviations for any protective groups, amino acids and other compounds, are, unless indicated otherwise, in accord with their common usage, recognized abbreviations, or the IUPAC-IUB Commission on Biochemical Nomenclature (see, (1972) *Biochem.* 11:1726).

For clarity of disclosure, and not by way of limitation, the detailed description is divided into the subsections that follow.

B. U-PA STRUCTURE AND FUNCTION

Urokinase-type plasminogen activator (u-PA, also called urokinase or urinary plasminogen activator) is a serine protease that catalyzes the hydrolysis of plasminogen into plasmin. u-PA is found in urine, blood, seminal fluids, and in many cancer tissues. It is involved in a variety of biological processes, which are linked to its conversion of plasminogen to plasmin, which itself is a serine protease. Plasmin has roles in a variety of normal and pathological processes including, for example, cell migration and tissue destruction through its cleavage of a variety of molecules including fibrin, fibronectin, proteoglycans, and laminin. u-PA is involved in tissue remodeling during wound healing, inflammatory cell migration, neovascularization and tumor cell invasion. u-PA also cleaves and activates other substrates, including, but not limited to, hepatocyte growth factor/scatter factor (HGF/SF), the latent form of membrane type 1 matrix metalloprotease (MT-SP1), platelet derived growth factors, and others.

Provided herein are modified Urokinase-type plasminogen activator (u-PA) polypeptides that are modified so that they cleave inhibitory sequences in C3, such that activation of C3 into C3a and C3b fragments is inhibited. The activity/specificity of the modified u-PA polypeptides provided herein is such that they cleave C3 with greater activity and/or specificity or $k_{cat}/k_m$ compared to the unmodified u-PA polypeptide, particularly of any of SEQ ID NOs: 1-6. The modified u-PA polypeptides also can have reduced activity or specificity or both for a native physiological substrate plasminogen of the unmodified u-PA polypeptide. Thus, the modified u-PA polypeptides provided herein inhibit complement activation in a complement pathway. The modified u-PA polypeptides also exhibit increased selectivity for cleaving C3 compared to other u-PA substrates, such as plasminogen. Therefore, the modified u-PA polypeptides provided herein do not exhibit undesired cleavage activities against physiological native u-PA substrates so that they do no exhibit undesirable side effects. In some embodiments, the modified u-PA polypeptide is a protease domain or a single chain form; in such instances, the free cysteine (residue position 122 by chymotrypsin numbering) is replaced with a serine, to decrease or eliminate aggregation upon preparation of the protein. In embodiments in which the modified u-PA polypeptide is full length or other form in which it is activated by cleavage, the residue at position 122 (by chymotrypsin numbering) generally is not replaced with S so that the disulfide bond can form to produce the two chain activated polypeptide.

1. Serine Proteases

Serine proteases (SPs), which include secreted enzymes and enzymes sequestered in cytoplasmic storage organelles, have a variety of physiological roles, including in blood coagulation, wound healing, digestion, immune responses and tumor invasion and metastasis. For example, chymotrypsin, trypsin, and elastase function in the digestive tract; Factor 10, Factor 11, Thrombin, and Plasmin are involved in clotting and wound healing; and C1r, C1s, and the C3 convertases play a role in complement activation.

A class of cell surface proteins designated type II transmembrane serine proteases are proteases which are membrane-anchored proteins with extracellular domains. As cell surface proteins, they play a role in intracellular signal transduction and in mediating cell surface proteolytic events. Other serine proteases are membrane bound and function in a similar manner. Others are secreted. Many serine proteases exert their activity upon binding to cell surface receptors, and, hence act at cell surfaces. Cell surface proteolysis is a mechanism for the generation of biologically active proteins that mediate a variety of cellular functions.

Serine proteases, including secreted and transmembrane serine proteases, are involved in processes that include neoplastic development and progression. While the precise role of these proteases has not been fully elaborated, serine proteases and inhibitors thereof are involved in the control of many intra- and extracellular physiological processes, including degradative actions in cancer cell invasion and metastatic spread, and neovascularization of tumors that are involved in tumor progression. Proteases are involved in the degradation and remodeling of extracellular matrix (ECM) and contribute to tissue remodeling, and are necessary for cancer invasion and metastasis. The activity and/or expression of some proteases have been shown to correlate with tumor progression and development.

More than 20 families (denoted S1-S27) of serine protease have been identified, and they are grouped into 6 clans (SA, SB, SC, SE, SF and SG) on the basis of structural similarity and other functional evidence (Rawlings N D et al. (1994) *Meth. Enzymol.* 244: 19-61). There are similarities in the reaction mechanisms of several serine peptidases. Chymotrypsin, subtilisin and carboxypeptidase C clans have a catalytic triad of serine, aspartate and histidine in common: serine acts as a nucleophile, aspartate as an electrophile, and histidine as a base. The geometric orientations of the catalytic residues are similar between families, despite different protein folds. The linear arrangements of the catalytic residues commonly reflect clan relationships. For example the catalytic triad in the chymotrypsin clan (SA) is ordered HDS, but is ordered DHS in the subtilisin clan (SB) and SDH in the carboxypeptidase clan (SC).

Examples of serine proteases of the chymotrypsin superfamily include tissue-type plasminogen activator (tPA), trypsin, trypsin-like protease, chymotrypsin, plasmin, elastase, urokinase (or urinary-type plasminogen activator, u-PA), acrosin, activated protein C, C1 esterase, cathepsin G, chymase, and proteases of the blood coagulation cascade including kallikrein, thrombin, and Factors VIIa, IXa, Xa, XIa, and XIIa (Barret, A. J., In: *Proteinase Inhibitors*, Ed. Barrett, A. J., et al., Elsevier, Amsterdam, Pages 3-22 (1986); Strassburger, W. et al., (1983) *FEBS Lett.*, 157:219-223; Dayhoff, M. O., *Atlas of Protein Sequence and Structure*, Vol 5, National Biomedical Research Foundation, Silver Spring, Md. (1972); and Rosenberg, R. D. et al. (1986) *Hosp. Prac.*, 21: 131-137).

The activity of proteases in the serine protease family is dependent on a set of amino acid residues that form their active site. One of the residues is always a serine; hence their designation as serine proteases. For example, chymotrypsin, trypsin, and elastase share a similar structure and their active serine residue is at the same position (Ser195) in all three. Despite their similarities, they have different substrate specificities; they cleave different peptide bonds during protein digestion. For example, chymotrypsin prefers an aromatic side chain on the residue whose carbonyl carbon is part of the peptide bond to be cleaved. Trypsin prefers a positively charged Lys or Arg residue at this position. Serine proteases differ markedly in their substrate recognition properties: some are highly specific (i.e. the proteases involved in blood coagulation and the immune complement system); some are only partially specific (i.e. the mammalian digestive proteases trypsin and chymotrypsin); and others, like subtilisin, a bacterial protease, are completely non-specific. Despite these differences in specificity, the catalytic mechanism of serine proteases is well conserved.

The mechanism of cleavage of a target protein by a serine protease is based on nucleophilic attack of the targeted peptidic bond by a serine. Cysteine, threonine or water molecules associated with aspartate or metals also can play this role. In many cases the nucleophilic property of the group is improved by the presence of a histidine, held in a "proton acceptor state" by an aspartate. Aligned side chains of serine, histidine and aspartate build the catalytic triad common to most serine proteases. For example, the active site residues of chymotrypsin, and serine proteases that are members of the same family as chymotrypsin, such as for example MTSP-1, are Asp102, His57, and Ser195.

The catalytic domains of all serine proteases of the chymotrypsin superfamily have sequence homology and structural homology. The sequence homology includes the conservation of: 1) the characteristic active site residues (e.g., Ser195, His57, and Asp102 in the case of trypsin); 2) the oxyanion hole (e.g., Gly193, Asp194 in the case of trypsin); and 3) the cysteine residues that form disulfide bridges in the structure (Hartley, B. S., (1974) *Symp. Soc. Gen. Microbiol.*, 24: 152-182). The structural homology includes 1) a common fold characterized by two Greek key structures (Richardson, J. (1981) *Adv. Prot. Chem.*, 34:167-339); 2) a common disposition of catalytic residues; and 3) detailed preservation of the structure within the core of the molecule (Stroud, R. M. (1974) *Sci. Am.*, 231: 24-88).

Throughout the chymotrypsin family of serine proteases, the backbone interaction between the substrate and enzyme is completely conserved, but the side chain interactions vary considerably. The identity of the amino acids that contain the S1-S4 pockets of the active site determines the substrate specificity of that particular pocket. Grafting the amino acids of one serine protease to another of the same fold modifies the specificity of one to the other. Typically, the amino acids of the protease that contain the S1-S4 pockets are those that have side chains within 4 to 5 angstroms of the substrate. The interactions these amino acids have with the protease substrate are generally called "first shell" interactions because they directly contact the substrate. There, however, can be "second shell" and "third shell" interactions that ultimately position the first shell amino acids. First shell and second shell substrate binding effects are determined primarily by loops between beta-barrel domains. Because these loops are not core elements of the protein, the integrity of the fold is maintained while loop variants with novel substrate specificities can be selected during the course of evolution to fulfill necessary metabolic or regulatory niches at the molecular level. Typically for serine proteases, the following amino acids in the primary sequence are determinants of specificity: 195, 102, 57 (the catalytic triad); 189, 190, 191, 192, and 226 (S1); 57, the loop between 58 and 64, and 99 (S2); 192, 217, 218 (S3); the loop between Cys168 and Cys180, 215, and 97 to 100 (S4); and 41 and 151 (S2'), based on chymotrypsin numbering, where an amino acid in an S1 position affects P1 specificity, an amino acid in an S2 position affects P2 specificity, an amino acid in the S3 position affects P3 specificity, and an amino acid in the S4 position affects P4 specificity. Position 189 in a serine protease is a residue buried at the bottom of the pocket that determines the S1 specificity. Structural determinants for u-PA are listed in Table 4, with protease domains for each of the designated proteases aligned with that of the protease domain of chymotrypsin. The number underneath the Cys168-Cys182 and 60's loop column headings indicate the number of amino acids in the loop between the two amino acids and in the loop. The yes/no designation under the Cys191-Cys220 column headings indicates whether the disulfide bridge is present in the protease. These regions are variable within the family of chymotrypsin-like serine proteases and represent structural determinants in themselves.

2. Structure u-PA cDNA has been cloned from numerous mammalian species. Exemplary u-PA precursor polypeptides, or preprourokinase polypeptides include, but are not limited to, human (SEQ ID NO:1 and encoded by SEQ ID NO:7), mouse (SEQ ID NO:52), rat (SEQ ID NO:53), bovine (SEQ ID NO:54), pig (SEQ ID NO:55), rabbit (SEQ ID NO:56), chicken (SEQ ID NO:57), yellow baboon (SEQ ID NO:58), Sumatran orangutan (SEQ ID NO:59), dog (SEQ ID NO:60), ovine (SEQ ID NO:61), marmoset (SEQ ID NO:62), rhesus monkey (SEQ ID NO:63), northern white-cheeked gibbon (SEQ ID NO:64) and chimpanzee (SEQ ID NO:65) u-PA polypeptides. The mRNA transcript is typically translated to generate a precursor protein containing a 20 amino acid signal sequence at the N-terminus. Following transport to the ER, the signal peptide is removed to yield a prourokinase polypeptide. Exemplary prourokinase polypeptides include, but are not limited to, human (SEQ ID NO:3), mouse (SEQ ID NO:66), rat (SEQ ID NO:67), bovine (SEQ ID NO:68), pig (SEQ ID NO:69), rabbit (SEQ ID NO:70), chicken (SEQ ID NO:71), yellow baboon (SEQ ID NO:72), Sumatran orangutan (SEQ ID NO:73), dog (SEQ ID NO:74), and ovine (SEQ ID NO:75) u-PA polypeptides. For example, the human u-PA mRNA transcript is normally translated to form a 431 amino acid precursor protein (SEQ ID NO:1) containing a 20 amino acid signal sequence at the N-terminus Met Arg Ala Leu Leu Ala Arg Leu Leu Leu Cys Val Leu Val Val Ser Asp Ser Lys Gly (amino acid residues 1-20 of SEQ ID NO:1). Thus, following transport to the ER and removal of the signal peptide, a 411 amino acid prourokinase polypeptide with a sequence of amino acids set forth in SEQ ID NO:3 is produced. As described in further detail below, prourokinase is a zymogen or proenzyme that is further processed by proteolytic cleavage to generate a two chain mature u-PA polypeptide. Thus, for example, with reference to mature u-PA (SEQ ID NO:3), the wild type chain activated u-PA contains a first chain (A chain), residues 1-158 linked by disulfide to residues 159-411 (B chain) via a disulfide bond between Cys148 (C97a chymotrypsin numbering) and Cys279 (C122 chymotrypsin numbering). Hence, in the modified u-PA polypeptides provided herein, when the protease domain is produced, it contains the replacement C122S, but when an activated form is produced that is a 2 chain form, the residue at 122 (chymotrypsin numbering) is C so that it forms a disulfide bond with another C, generally in the activation sequence (see discussion below and Example 15).

Human precursor u-PA has a sequence of amino acids set forth in SEQ ID NO:1 and encoded by a sequence of nucleotides set forth in SEQ ID NO:7. Human pro-u-PA, also termed mature u-PA, lacking the signal sequence is set forth in SEQ ID NO:3. Two isoforms of human u-PA exist, as produced by alternative splicing. Isoform 1 of human u-PA is the canonical form described above set forth in SEQ ID NO:1. In isoform 2 of human u-PA, amino acids 1-29 of SEQ ID NO:1 are replaced with amino acids 1-12 of SEQ ID NO: 51, with the resulting protein containing 414 amino acids (set forth in SEQ ID NO:51). Allelic variants and other variants of human u-PA are known. For example, a uPA variant is known containing the amino acid modification V15L in the sequence of amino acids set forth in SEQ ID NO:1. In another example, a modified u-PA polypeptide is known containing the amino acid modification C299S (C122S by chymotrypsin numbering) in the sequence of amino acids set forth in SEQ ID NO:1 (corresponding to the sequence of amino acids set forth in SEQ ID NO: 4). Additional variants include those containing amino acid modifications P121L, D130G, C131W, I194M, K211Q, G366c and A410V in mature u-PA set forth in SEQ ID NO:3 (corresponding to amino acid modifications P141L, D150G, C151W, I214M, K231Q, G386C and A430V in SEQ ID NO:1).

u-PA polypeptides are synthesized and secreted as a single-chain zymogen molecules (also called prourokinases or single-chain urokinases), which are converted into active two-chain u-PAs by a variety of proteases including, for example, plasmin, kallikrein, cathepsin B, matriptase and nerve growth factor γ. Cleavage to generate the two chain form occurs between residues 158 and 159 (SEQ ID NO:3) in the human prourokinase sequence (corresponding to amino acid residues 178 and 179 in SEQ ID NO:1). The two resulting chains are linked by a disulfide bond between Cys148 and Cys279, thereby forming the two-chain form of u-PA. The two chain form of u-PA also is called high molecular weight u-PA (HMW-u-PA). HMW-u-PA can be further processed into low molecular weight u-PA (LMW-u-PA) by cleavage of the A chain into a short chain A (A1, amino acids 136-157 of SEQ ID NO:3) and an amino terminal fragment. 21-178 linked disulfide to 179-411 linked via Cys corresponding to Cys148 and Cys279 (SEQ ID NO:3).

Urokinase-type plasminogen activator, u-PA, is a classical serine protease, containing a His-Asp-Ser catalytic triad, that cleaves a specific Arg-Val bond in plasminogen to form plasmin. Plasmin in turn can cleave u-PA at Lys158-Ile159 of SEQ ID NO:3 (corresponding to Lys15-Ile16 by chymotrypsin numbering) forming the two-chain form described above. The catalytic triad of human u-PA includes amino acids His204, Asp255 and Ser356 of SEQ ID NO:3 (corresponding to His57, Asp102 and Ser195 by chymotrypsin numbering). Residues Ser138 and Ser303 of the human uPA set forth in SEQ ID NO:3 are phosphorylated (Franco et al. (1997) *J Cell Biol* 137:779-791). Human u-PA contains O-linked glycosylation, e.g. fucosylation, at amino acid residue Thr18 of SEQ ID NO:3 (Buko et al. (1991) *Proc Natl Acad Sci USA* 88:3992-3996) and N-linked glycosylation at amino acid residue Asn302 of SEQ ID NO:3. Mature human u-PA contains intrachain disulfide bonds between residues C11-C19, C13-C31, C33-C42, C50-C131, C71-C113, C102-C126, C189-C205, C197-C268, C293-C362, C325-C341 and C352-C380 of SEQ ID NO:3 and an interchain disulfide bond between residues C148-C279 of SEQ ID NO:3.

The mature form of u-PA is a 411 residue protein (corresponding to amino acid residues 21 to 431 in the sequence of amino acids set forth in SEQ ID NO:1 which is the precursor form containing a 20 amino acid signal peptide). u-PA contains three domains: the serine protease domain, the kringle domain and the growth factor domain. In the mature form of human u-PA, amino acids 1-158 represent the N-terminal A chain including a growth factor domain (amino acids 1-49), a kringle domain (amino acids 50-131), and an interdomain linker region (amino acids 132-158). Amino acids 159-411 represent the C-terminal serine protease domain or B chain. u-PA is synthesized and secreted as a single-chain zymogen molecule, which is converted into an active two-chain u-PA by a variety of proteases including, for example, plasmin, kallikrein, cathepsin B, and nerve growth factor-γ (gamma). Cleavage into the two chain form occurs between residues 158 and 159 in a mature u-PA sequence (corresponding to amino acid residues 178 and 179 in SEQ ID NO:3). The two resulting chains are kept together by a disulfide bond, thereby forming the two-chain form of u-PA.

Urokinase-type plasminogen activators contain three domains: a serine protease domain, a kringle domain and a growth factor domain. In the zymogen or proenzyme form of human u-PA, amino acids 1-158 of SEQ ID NO:3 represent the N-terminal A chain (or long chain A) including an epidermal growth factor domain (amino acids 1-49), a kringle domain (amino acids 50-131) and an interdomain linker region (amino acids 132-158) and amino acids 159-411 represent the catalytically active C-terminal serine protease domain or B chain. The epidermal growth factor domain is responsible for binding of u-PA to the cell surface-anchored u-PA receptor (uPAR). In the extracellular matrix, u-PA is tethered to the cell membrane by binding to the u-PA receptor. LMW-u-PA is proteolytically active but does not bind the u-PA receptor. The serine protease domain contains surface-exposed loops around residues 37, 60, 96, 110, 170 and 185, by chymotrypsin numbering. Upon activation or cleavage, the amino terminus inserts into a hydrophobic binding cleft of the catalytic protease domain forming hydrophobic interactions and a salt bridge to the side pocket of Asp194 which stabilizes the substrate binding pocket and oxyanion hole in a catalytically productive conformation. Asp194, according to chymotrypsin numbering, participates in hydrogen bonding to the main chain amino group of Gly142 and the main chain carbonyl group of Lys143 (Blouse et al. (2009) *J Biol Chem* 284:4647-4657). Conformational changes after cleavage involves four disordered regions of the activation domain, including the activation loop (residues 16-21), the autolysis loop (residues 142-152), the oxyanion stabilizing loop (residues 184-194) and the S1 entrance frame (residues 216-223), all numbering according to chymotrypsin numbering (see, Blouse et al. (2009) *J Biol Chem* 284:4647-4657; Hedstrom (2002) *Chem Rev* 102:4501-4524; Huber and Bode (1978) *Acc Chem Res* 11:114-122; Madison et al. (1993) *Science* 262:419-421).

Structural determinants for u-PA are set forth in Table 4 below with numbering based on the numbering of mature chymotrypsin. The number underneath the Cys168-Cys182 and 60's loop column headings indicates the number of amino acids in the loop between the two amino acids and in the loop. The yes designation under the Cys191-Cys220 column headings indicates a disulfide bridge is present. These regions are variable within the family of chymotrypsin-like serine proteases and represent structural determinants in themselves. Modification of a u-PA polypeptide to alter any one or more of the amino acids in the S1-S4 pocket affects the specificity or selectivity of the u-PA polypeptide for a target substrate. The extended substrate specificity (P1-P4) reveals that u-PA has a high specificity for cleavage after P1 Arg, a preference for small amino acids at the P2 position, a preference for small polar amino acids (Thr and Ser) at the P3 position and no preference at the P4 position (Ke et al. (1997) *J. Biol. Chem.*, 272:16603-16609; Harris et al. (2000) *Proc Natl Acad Sci USA*, 97:7754-7759).

TABLE 4

Structural Determinants for u-PA substrate cleavage (chymotrypsin numbering) Residues that Determine Specificity

| S4 | | | | | | | | | | | | S1 |
|---|---|---|---|---|---|---|---|---|---|---|---|---|
| | | | Cys168 | S3 | | S2 | | | | | | Cys191 |
| 171 | 174 | 180 | 215 | Cys182 | 192 | 218 | 99 | 57 | 60's loop | 189 | 190 | 226 | Cys220 |
| H | S | M | W | 15 | Q | R | H | H | 11 | D | S | G | yes |

3. Function/Activity

Urokinase-type plasminogen activator is a serine protease that catalyzes the hydrolysis of plasminogen into plasmin. Plasmin acts directly on the degradation of extracellular matrix proteins (Andreasen et al. (2000) *Cell. Mol. Life Sci.* 57:25-40). u-PA plays an important role in cell adhesion, migration and invasion, tissue remodeling and cancer (Blasi et al. (2002) *Rev Mol Cell Biol* 3:932; Andreasen et al. (2000) *Cell. Mol. Life Sci.* 57:25-40; Mondino and Blasi (2004) *Trends Immunol* 25:450; Ploug (2003) *Curr Pharm Des* 9:1499). Abnormal expression of u-PA has been associated with rheumatoid arthritis, allergic vasculitis, xeroderma pigmentosum and the invasive capacity of malignant tumors.

u-PA is regulated by the binding to the high affinity cell surface receptor uPAR. Binding of u-PA to uPAR increases the rate of plasminogen activation and enhances extracellular matrix degradation and cell invasion. The binary complex formed between uPAR and u-PA interacts with membrane-associated plasminogen to form higher order activation complexes that reduce the Km (i.e. kinetic rate constant of the approximate affinity for a substrate) for plasminogen activation (Bass et al. (2002) *Biochem. Soc. Trans.*, 30: 189-194). Binding of u-PA to uPAR protects the protease from inhibition by the cognate inhibitor, i.e. PAI-1. This is because single chain u-PA normally present in plasma is not susceptible to inhibition by PAI-1, and any active u-PA in the plasma will be inhibited by PAI-1. Active u-PA that is receptor bound is fully available for inhibition by PAI-1, however, PAI-1 is unable to access the bound active molecule (Bass et al. (2002) *Biochem. Soc. Trans.*, 30: 189-194). As a result, u-PA primarily functions on the cell surface and its functions are correlated with the activation of plasmin-dependent pericellular proteolysis.

u-PA also cleaves hepatocyte growth factor/scatter factor (HGF/SF), the latent form of membrane type 1 matrix metalloprotease (MT-SP1; matriptase), platelet derived growth factor C (PDGF-C), platelet derived growth factor D (PDGF-D), platelet derived growth factor DD (PDGF-DD) and other proteins (see, e.g., Hurst et al. (2012) *Biochem J* 441:909-918; Ustach and Kim (2005) *Mol Cell Biol* 5:6279-6288; Ehnman et al. (2009) *Oncogene* 28(4):534-544). Plasmin degrades fibrin clots, cleaves fibrin, fibronectin, thrombospondin, laminin and von Willebrand factor, proteolyzes mediators of complement system, and activates collagenases. As such, plasmin participates in thrombolysis or extracellular matrix degradation, linking to plasmin to vascular diseases and cancer. For example, components of the plasminogen activation system have been observed to be highly expressed in malignant tumors. Hepatocyte growth factor/scatter factor regulates cell growth, cell motility and morphogenesis by binding of activated HGF to the HGF-receptor c-Met and its ability to stimulate mitogenesis, cell motility and matrix invasion links it to angiogenesis, tumorigenesis and tissue regeneration. Platelet derived growth factors regulate cell growth and division, and play a significant role in angiogenesis, which, when uncontrolled, is a characteristic of cancer. Once activated by proteolytic cleavage, PDGFs bind PGDF receptor tyrosine kinases leading to phosphorylation and a number of downstream signaling pathways involved in cancer. Due to the role of u-PA and the above mentioned proteins in vascular diseases the u-PA polypeptides provided herein are altered such that they reduced selectivity towards these proteins. By virtue of the changes in their specificity and activity, the modified u-PA polypeptides provided herein exhibit reduced or no activity or no substantial activity on native substrates, and high activity, compared to unmodified u-PA on complement protein C3. As a result, at therapeutic dosages, the modified u-PA polypeptides provided herein specifically inhibit complement activation but have none or few side effects from cleavage of natural u-PA targets.

C. COMPLEMENT INHIBITION BY TARGETING C3

The modified u-PA polypeptides provided herein exhibit increased specificity and/or activity for an inhibitory cleavage sequence in complement protein C3 compared to u-PA not containing the amino acid modifications (e.g. wild type human u-PA (see, SEQ ID NO:1 or 3)) or the catalytic domain or protease domain thereof (see, SEQ ID NO:2) or corresponding unmodified u-PA polypeptides that include the replacement C122S, by chymotrypsin numbering. Replacement with S at residue 122 does not alter specificity or activity on C3, but reduces aggregation. Since C3 is involved in the 3 initiation pathways of complement (see, e.g., FIG. 1), targeting C3 by proteolytic inhibition provides a general and broad therapeutic target for inactivation of the complement cascade. Inactivation cleavage of C3 blocks terminal activity of complement as well as the alternative pathway amplification loop. All three pathways converge at C3 (see, e.g., FIG. 1). By virtue of the ability to inhibit complement activation, such modified u-PA polypeptides can be used to treat various diseases, conditions and pathologies associated with complement activation, such as inflammatory responses and autoimmune diseases. Complement activation is associated with the development of diseases and conditions by promoting local inflammation and damage to tissues caused in part by the generation of effector molecules and a membrane attack complex. In one example, such as in many autoimmune diseases, complement produces tissue damage because it is activated under inappropriate circumstances such as by antibody to host tissues. In other situations, complement can be activated normally, such as by septicemia, but still contributes to disease progression, such as in respiratory distress syndrome. Pathologically, complement can cause substantial damage to blood vessels (vasculitis), kidney basement membrane and attached endothelial and epithelial cells (nephritis), joint synovium (arthritis), and erythrocytes (hemolysis) if not adequately controlled. The role of C3 in complement activation is discussed in further detail below.

1. Complement Protein C3 and its Role in Initiating Complement

The complement system involves over 30 soluble and cell-membrane bound proteins that function not only in the antibody-mediated immune response, but also in the innate immune response to recognize and kill pathogens such as bacteria, virus-infected cells, and parasites. Complement activation is initiated on pathogen surfaces through three distinct pathways: the classical pathway, the alternative pathway, and the lectin pathway. These pathways are distinct in that the components required for their initiation are different, but the pathways ultimately generate the same set of effector molecules (e.g., C3 convertases) which cleave complement protein C3 to trigger the formation of the membrane attack complex (MAC) (see, e.g., FIG. 1). Thus, complement protein C3 is an attractive target for a therapeutic since modulation of C3 results in modulation of various opsonins, anaphylatoxins and the MAC. Further, naturally occurring complement inhibitor proteins including factor H (FH), CR1, complement receptor Ig (CR1g), DAF and MCP inhibit at the C3 level.

There are three (3) pathways of complement activation (See, FIG. 1, which depicts these pathways). The pathways of complement are distinct; each relies on different molecules and mechanisms for initiation. The pathways are similar in that they converge to generate the same set of effector molecules, i.e., C3 convertases. In the classical and lectin pathways, C4b2b acts as a C3 convertase; in the alternative pathway, C3bBb is a C3 convertase (see Table 5). Cleavage of C3 generates C3b, which acts as an opsonin and as the main effector molecule of the complement system for subsequent complement reactions, and C3a, which is a peptide mediator of inflammation. The addition of C3b to each C3 convertase forms a C5 convertase that generates C5a and C5b. C5a, like C3a, is a peptide mediator of inflammation. C5b mediates the "late" events of complement activation initiating the sequence of reactions culminating in the generation of the membrane attack complex (MAC). Although the three pathways produce different C3 and C5 convertases, all of the pathways produce the split products of C3 and C5 and form MAC. Alternatively, C3 can be cleaved and activated by extrinsic proteases, such as lysosomal enzymes and elastase (Markiewski and Lambris (2007) *Am J Pathology* 171:715-727; Ricklin and Lambris (2007) *Nat Biotechnol* 25:1265-1275).

TABLE 5

Complement Cascades

| Activators | Alternative Pathway Pathogen surface molecules LPS, teichoic acid, zymosan | Classical Pathway antigen-bound IgM and IgG; non-immune molecules | Lectin Pathway Pathogens via recognition of carbohydrates on surface |
|---|---|---|---|
| C3 convertase | C3bBb | C4b2b | C4b2b |
| C5 convertase | C3bBb3b | C4b2b3b | C4b2b3b |
| MAC | C5678poly9 | C5678poly9 | C5678poly9 |
| anaphylatoxins | C3a, C5a | C3a, C4a, C5a | C3a, C4a, C5a | a. Classical Pathway

C1q is the first component of the classical pathway of complement. C1q is a calcium-dependent binding protein associated with the collectin family of proteins due to an overall shared structural homology (Malhotra et al., (1994) *Clin Exp Immunol.* 97(2):4-9; Holmskov et al. (1994) *Immunol Today* 15(2):67-74). Collectins, often called pattern recognition molecules, generally function as opsonins to target pathogens for phagocytosis by immune cells. In contrast to conventional collectins, such as MBL, the carboxy-terminal globular recognition domain of C1q does not have lectin activity but can serve as a "charged" pattern recognition molecule due to marked differences in the electrostatic surface potential of its globular domains (Gaboriaud et al. (2003) *J. Biol. Chem.* 278(47):46974-46982).

C1q initiates the classical pathway of complement in two different ways. First, the classical pathway is activated by the interaction of C1q with immune complexes (i.e. antigen-antibody complexes or aggregated IgG or IgM antibody) thus linking the antibody-mediated humoral immune response with complement activation. When the Fab portion (the variable region) of IgM or IgG binds antigen, the conformation of the Fc (constant) region is altered, allowing C1q to bind. C1q must bind at least 2 Fc regions to be activated. C1q, however, also is able to activate complement in the absence of antibody thereby functioning in the innate or immediate immune response to infection. Besides initiation by an antibody, complement activation also is achieved by the interaction of C1q with non-immune molecules such as polyanions (bacterial lipopolysaccharides, DNA, and RNA), certain small polysaccharides, viral membranes, C reactive protein (CRP), serum amyloid P component (SAP), and bacterial, fungal and virus membrane components.

C1q is part of the C1 complex which contains a single C1q molecule bound to two molecules each of the zymogens C1r and C1s. Binding of more than one of the C1q globular domains to a target surface (such as aggregated antibody or a pathogen), causes a conformational change in the (C1r:C1s)$_2$ complex which results in the activation of the C1r protease to cleave C1s to generate an active serine protease. Active C1s cleaves subsequent complement components C4 and C2 to generate C4b and C2b, which together form the C3 convertase of the classical pathway. The C3 convertase cleaves C3 into C3b, which covalently attaches to the pathogen surface and acts as an opsonin, and C3a, which stimulates inflammation. Some C3b molecules associate with C4b2b complexes yielding C4b2b3b which is the classical cascade C5 convertase. Table 6 summarizes the proteins involved in the classical pathway of complement.

TABLE 6

Proteins of the Classical Pathway

| Native Component | Active Form | Function of the Active Form |
|---|---|---|
| C1 (C1q:(C1r:C1s)$_2$) | C1q | Binds directly to pathogen surfaces or indirectly to antibody bound to pathogens |
| | C1r | Cleaves C1s to an active protease |
| | C1s | Cleaves C4 and C2 |
| C4 | C4b | Binds to pathogen and acts as an opsonin; binds C2 for cleavage by C1s |
| | C4a | Peptide mediator of inflammation |
| C2 | C2b | Active enzyme of classical pathway C3/C5 convertase; cleaves C3 and C5 |
| | C2a | Precursor of vasoactive C2 kinin |
| C3 | C3b | Binds to pathogen surfaces and acts as an opsonin; initiates amplification via the alternative pathway; binds C5 for cleavage by C2b |
| | C3a | Peptide mediator of inflammation | b. Alternative Pathway

The alternative pathway is initiated by foreign pathogens in the absence of antibody. Initiation of complement by the alternative pathway occurs through the spontaneous hydrolysis of C3 into C3b. A small amount of C3b is always present in body fluids, due to serum and tissue protease activity. Host self-cells normally contain high levels of membrane sialic acid which inactivate C3b if it binds, but bacteria contain low external sialic acid levels and thereby bind C3b without inactivating it. C3b on pathogen surfaces is recognized by the protease zymogen Factor B. Factor B is cleaved by Factor D. Factor D is the only activating protease of the complement system that circulates as an active enzyme rather than as a zymogen, but since Factor B is the only substrate for Factor D the presence of low levels of an active protease in normal serum is generally safe for the host. Cleavage of Factor B by Factor D yields the active product Bb which can associate with C3b to form C3bBb, the C3 convertase of the alternative pathway. Similar to the classical pathway, the C3 convertase produces more C3b and C3a from C3. C3b covalently attaches to the pathogen surface and acts as an opsonin and additionally initiates the alternative pathway, while C3a stimulates inflammation. Some C3b joins the complex to form C3bBb3b, the alternative pathway C5 convertase. C3bBb3b is stabilized by the plasma protein properdin or Factor P which binds to microbial surfaces and stabilizes the convertase. Table 7 summarizes the proteins involved in the alternative pathway of complement.

TABLE 7

Proteins of the Alternative Pathway

| Native Component | Active Form | Function of the Active Form |
|---|---|---|
| C3 | C3b | Binds to pathogen surface, binds Factor B for cleavage by Factor D |
| Factor B | Ba | Small fragment of Factor B, unknown function |
| | Bb | Active enzyme of the C3 convertase and C5 convertase |
| Factor D | D | Plasma serine protease, cleaves Factor B when it is bound to C3b to Ba and Bb |
| Factor P (properdin) | P | Plasma proteins with affinity for C3bBb convertase on bacterial cells; stabilizes convertase | c. Lectin Pathway

The lectin pathway (also referred to as the MBL pathway) is initiated following recognition and binding of pathogen-associated molecular patterns (PAMPs; i.e. carbohydrates moieties) by lectin proteins. Examples of lectin proteins that activate the lectin pathway of complement include mannose binding lectin (MBL) and ficolins (i.e. L-ficolin, M-ficolin, and H-ficolin). MBL is a member of the collectin family of proteins and thereby exists as an oligomer of subunits composed of identical polypeptide chains each of which contains a cysteine-rich, a collagen-like, a neck, and a carbohydrate-recognition or lectin domain. MBL acts as a pattern recognition molecule to recognize carbohydrate moieties, particularly neutral sugars such as mannose or N-acetylglucosamine (GlcNAc) on the surface of pathogens via its globular lectin domain in a calcium-dependent manner. MBL also acts as an opsonin to facilitate the phagocytosis of bacterial, viral, and fungal pathogens by phagocytic cells. Additional initiators of the lectin pathway include the ficolins including L-ficolin, M-ficolin, and H-ficolin (see e.g., Liu et al. (2005) *J Immunol.* 175:3150-3156). Similar to MBL, ficolins recognize carbohydrate moieties such as, for example, N-acetyl glucosamine and mannose structures.

The activation of the alternative pathway by MBL or ficolins is analogous to activation of the classical pathway by C1q whereby a single lectin molecule interacts with two protease zymogens. In the case of the lectin proteins, the zymogens are MBL-associated serine proteases, MASP-1 and MASP-2, which are closely homologous to the C1r and C1s zymogens of the classical pathway. Upon recognition of a PAMP by a lectin protein, such as for example by binding to a pathogen surface, MASP-1 and MASP-2 are activated to cleave C4 and C2 to form the MBL cascade C3 convertase. C3b then joins the complex to form the MBL cascade C5 convertase. MASP activation is implicated not only in responses to microorganisms, but in any response that involves exposing neutral sugars, including but not limited to tissue injury, such as that observed in organ transplants. Like the alternative cascade, the MBL cascade is activated independent of antibody; like the classical cascade, the MBL cascade utilizes C4 and C2 to form C3 convertase. Table 8 summarizes the proteins involved in the lectin pathway of complement.

TABLE 8

Proteins of the Lectin Pathway

| Native Component | Active Form | Function of the Active Form |
|---|---|---|
| MBL | MBL | Recognizes PAMPs, such as on pathogen surfaces (e.g., via recognition of carbohydrates) |
| Ficolins | L-Ficolin; M-Ficolin, or H-Ficolin | Recognizes PAMPs, such as on pathogen surfaces (e.g., via recognition of carbohydrates) |
| MASP-1 | MASP-1 | Cleaves C4 and C2 |
| MASP-2 | MASP-2 | Cleaves C4 and C2 | d. Complement-Mediated Effector functions

Regardless of which initiation pathway is used, the end result is the formation of activated fragments of complement proteins (e.g. C3a, C4a, and C5a anaphylatoxins and C5b-9 membrane attack complexes), which act as effector molecules to mediate diverse effector functions. The recognition of complement effector molecules by cells for the initiation of effector functions (e.g. chemotaxis and opsonization) is mediated by a diverse group of complement receptors. The complement receptors are distributed on a wide range of cell types including erythrocytes, macrophages, B cells, neutrophils, and mast cells. Upon binding of a complement component to the receptor, the receptors initiate an intracellular signaling cascade resulting in cell responses such as stimulating phagocytosis of bacteria and secreting inflammatory molecules from the cell. For example, the complement receptors CR1 and CR2 which recognize C3b, C4b, and their products are important for stimulating chemotaxis. CR3 (CD11b/CD18) and CR4 (CD11c/CD18) are integrins that are similarly important in phagocytic responses but also play a role in leukocyte adhesion and migration in response to iC3b. The C5a and C3a receptors are G protein-coupled receptors that play a role in many of the pro-inflammatory-mediated functions of the C5a and C3a anaphylatoxins. For example, receptors for C3a, C3aR, exist on mast cells, eosinophils, neutrophils, basophils and monocytes and are directly involved in the pro-inflammatory effects of C3a.

Thus, through complement receptors, these complement effector molecule fragments mediate several functions including leukocyte chemotaxis, activation of macrophages, vascular permeability and cellular lysis (Frank, M. and Fries, L. Complement. In Paul, W. (ed.) Fundamental Immunology, Raven Press, 1989). A summary of some effector functions of complement products are listed in Table 9.

TABLE 9

Complement Effector Molecules and Functions

| Product | Activity |
|---|---|
| C2b (prokinin) | accumulation of body fluid |
| C3a (anaphylatoxin) | basophil and mast cell degranulation; enhanced vascular permeability; smooth muscle contraction; Induction of suppressor T cells |
| C3b and its products | opsonization; phagocyte activation |
| C4a (anaphylatoxin) | basophil & mast cell activation; smooth muscle contraction; enhanced vascular permeability |
| C4b | opsonization |
| C5a (anaphylatoxin; chemotactic factor) | basophil & mast cell activation; enhanced vascular permeability; smooth muscle contraction; chemotaxis; neutrophil aggregation; oxidative metabolism stimulation; stimulation of leukotriene release; induction of helper T-cells |
| C5b67 | chemotaxis; attachment to other cell membranes and lysis of bystander cells |
| C5b6789 (C5b-9) | lysis of target cells | i. Complement-Mediated Lysis: Membrane Attack Complex

The final step of the complement cascade by all three pathways is the formation of the membrane attack complex (MAC) (FIG. 1). C5 can be cleaved by any C5 convertase into C5a and C5b. C5b combines with C6 and C7 in solution, and the C5b67 complex associates with the pathogen lipid membrane via hydrophobic sites on C7. C8 and several molecules of C9, which also have hydrophobic sites, join to form the membrane attack complex, also called C5b6789 or C5b-9. C5b-9 forms a pore in the membrane through which water and solutes can pass, resulting in osmotic lysis and cell death. If complement is activated on an antigen without a lipid membrane to which the C5b67 can attach, the C5b67 complex can bind to nearby cells and initiate bystander lysis. A single MAC can lyse an erythrocyte, but nucleated cells can endocytose MAC and repair the damage unless multiple MACs are present. Gram negative bacteria, with their exposed outer membrane and enveloped viruses, are generally susceptible to complement-mediated lysis. Less susceptible are Gram positive bacteria, whose plasma membrane is protected by their thick peptidoglycan layer, bacteria with a capsule or slime layer around their cell wall, or viruses which have no lipid envelope. Likewise, the MAC can be disrupted by proteins that bind to the complex before membrane insertion such as Streptococcal inhibitor of complement (SIC) and clusterin. Typically, the MAC helps to destroy Gram-negative bacteria as well as human cells displaying foreign antigens (virus-infected cells, tumor cells, etc.) by causing their lysis and also can damage the envelope of enveloped viruses.

ii. Inflammation

Inflammation is a process in which blood vessels dilate and become more permeable, thus enabling body defense cells and defense chemicals to leave the blood and enter the tissues. Complement activation results in the formation of several proinflammatory mediators such as C3a, C4a and C5a. The intact anaphylatoxins in serum or plasma are quickly converted into the more stable, less active C3a-desArg, C4a-desArg, or C5a-desArg forms, by carboxypeptidase N. C3a, C4a and C5a, and to a lesser extent their desArg derivatives, are potent bioactive polypeptides, termed anaphylatoxins because of their inflammatory activity. Anaphylatoxins bind to receptors on various cell types to stimulate smooth muscle contraction, increase vascular permeability, and activate mast cells to release inflammatory mediators. C5a, the most potent anaphylatoxin, primarily acts on white blood cells, particularly neutrophils. C5a stimulates leukocyte adherence to blood vessel walls at the site of infection by stimulating the increased expression of adhesion molecules so that leukocytes can squeeze out of the blood vessels and into the tissues, a process termed diapedesis. C5a also stimulates neutrophils to produce reactive oxygen species for extracellular killing, proteolytic enzymes, and leukotrienes. C5a also can further amplify the inflammatory process indirectly by inducing the production of chemokines, cytokines, and other proinflammatory mediators. C5a also interacts with mast cells to release vasodilators such as histamine so that blood vessels become more permeable. C3a also interacts with white blood cells, with major effects on eosinophils suggesting a role for C3a in allergic inflammation. C3a induces smooth muscle contraction, enhances vascular permeability, and causes degranulation of basophils and release of histamine and other vasoactive substances. C2a can be converted to C2 kinin, which regulates blood pressure by causing blood vessels to dilate.

Although technically not considered an anaphylatoxin, iC3b, an inactive derivative of C3b, functions to induce leukocyte adhesion to the vascular endothelium and induce the production of the pro-inflammatory cytokine IL-1 via binding to its cell surface integrin receptors. C5b-9 also indirectly stimulates leukocyte adhesion, activation, and chemotaxis by inducing the expression of cell adhesion molecules such as E-selectin, and inducing interleukin-8 secretion (Bhole et al. (2003) Crit Care Med 31(1):97-104). C5b-9 also stimulates the release of secondary mediators that contribute to inflammation, such as for example, prostaglandin $E_2$, leukotriene $B_4$, and thromboxane.

Conversion of the human complement components C3 and C5 to yield their respective anaphylatoxin products has been implicated in certain naturally occurring pathologic states including: autoimmune disorders such as systemic lupus erythematosus, rheumatoid arthritis, malignancy, myocardial infarction, Purtscher's retinopathy, sepsis and adult respiratory distress syndrome. Increased circulating levels of C3a and C5a have been detected in certain conditions associated with iatrogenic complement activation such as: cardiopulmonary bypass surgery, renal dialysis, and nylon fiber leukaphoresis.

iii. Chemotaxis

Chemotaxis is a process by which cells are directed to migrate in response to chemicals in their environment. In the immune response, a variety of chemokines direct the movement of cells, such as phagocytic cells, to sites of infection. For example, C5a is the main chemotactic factor for circulating neutrophils, but also can induce chemotaxis of monocytes. Phagocytes move towards increasing concentrations of C5a and subsequently attach, via their CR1 receptors, to the C3b molecules attached to the antigen. The chemotactic effect of C5a, observed with basophils, eosinophils, neutrophils, and mononuclear phagocytes, is active at concentrations as low as $10^{-10}$ M.

iv. Opsonization

An important action of complement is to facilitate the uptake and destruction of pathogens by phagocytic cells. This occurs by a process termed opsonization whereby complement components bound to target bacteria interact with complement receptors on the surface of phagocytic cells such as neutrophils or macrophages. In this instance, the complement effector molecules are termed opsonins. Opsonization of pathogens is a major function of C3b and C4b. iC3b also functions as an opsonin. C3a and C5a increase the expression of C3b receptors on phagocytes and increase their metabolic activity.

C3b and, to a lesser extent, C4b help to remove harmful immune complexes from the body. C3b and C4b attach the immune complexes to CR1 receptors on erythrocytes. The erythrocytes then deliver the complexes to fixed macrophages within the spleen and liver for destruction. Immune complexes can lead to a harmful Type III hypersensitivity.

v. Activation of the Humoral Immune Response

Activation of B cells requires ligation of the B cell receptor (BCR) by antigen. It has been shown, however, that complement plays a role in lowering the threshold for B cell responses to antigen by up to 1000-fold. This occurs by the binding of C3d or C3dg, complement products generated from the breakdown fragments of C3, to CR2 receptors on B-lymphocytes which can co-ligate with the BCR. Co-ligation occurs when antigenic particles, such as for example immune complexes, opsonized with C3d bind the CR2 receptor via C3d as well as the BCR through antigen. Co-ligation of antigen complexes also can occur when C3d binds to antigens enhancing their uptake by antigen presenting cells, such as dendritic cells, which can then present the antigen to B cells to enhance the antibody response. Mice deficient in CR2 display defects in B cell function that result in reduced levels of natural antibody and impaired humoral immune responses.

2. C3 Structure and Function

The variant u-PA polypeptides provided herein cleave complement protein C3 or its proteolytic fragments thereby inhibiting complement. Human complement protein C3 (Uniprot Accession No. P01024) is a 1663 amino acid single chain pre-proprotein having an amino acid sequence set forth in SEQ ID NO:47. The protein is encoded by a 41 kb gene located on chromosome 19 (nucleotide sequence set forth in SEQ ID NO:46). The pre-proprotein contains a 22 amino acid signal peptide (amino acids 1-22 of SEQ ID NO:47) and a tetra-arginine sequence (amino acids 678-681 of SEQ ID NO:47) that is removed by a furin-like enzyme resulting in formation of a mature two chain protein containing a beta chain (amino acids 23-667 of SEQ ID NO:47) and an alpha chain (amino acids 672-1663 of SEQ ID NO:47), that are linked by an interchain disulfide bond between amino acid residues Cys559 and Cys816. The mature 2 chain protein has a sequence of amino acids set forth in SEQ ID NO:77.

During the complement cascade, complement protein C3 is further processed by proteolytic cleavage to form various C3 proteolytic fragments. As described above, all three complement initiation pathways converge on the C3 convertases C4b2b and C3bBb. C3 convertases cleave C3 between residues 748 and 749 of SEQ ID NO:47 (see Table 10 below) generating the anaphylatoxin C3a (amino acids 672-748 of SEQ ID NO:47) and the opsonin C3b (C3b alpha' chain; amino acids 749-1663 of SEQ ID NO:47). C3a is involved in inflammation and C3b forms the C5 convertases ultimately leading to C5a anaphylatoxin and the MAC. The variant u-PA polypeptides provided herein inhibit complement, and as such, do not cleave C3 at this GLAR cleavage site.

C3b has binding sites for various complement components including C5, properdin (P), factors H, B and I, complement receptor 1 (CR1) and the membrane co-factor protein (MCP) (see Sahu and Lambris (2001) *Immunological Reviews* 180:35-48). Binding of Factor I, a plasma protease, in the presence of cofactors H, CR1 and MCP results in inactivation of C3b whereas binding of factors B and P in the presence of factor D results in amplification of C3 convertase and initiation of MAC. Factor I cleaves C3b in the presence of cofactors between residues 1303-1304, 1320-1321 and 954-955 of SEQ ID NO:47 (see Table 10 below) generating fragments iC3b (amino acids 749-1303 of SEQ ID NO:47) and C3f (amino acids 1304-1320 of SEQ ID NO:47). Factor I subsequently cleaves iC3b generating C3c (C3c alpha' chain Fragment 1; amino acids 749-954 of SEQ ID NO:47) and C3dg (amino acids 955-1303 of SEQ ID NO:47). The end result is that C3b is permanently inactivated (see Sahu and Lambris (2001) *Immunological Reviews* 180:35-48). Since Factor I inactivates C3b, the Factor I cleavage sites are candidates for cleavage by the variant u-PA polypeptides provided herein. Additional C3b proteolytic fragments include C3g (amino acids 955-1001 of SEQ ID NO:47), C3d (amino acids 1002-1303 of SEQ ID NO:47), and C3c alpha' chain Fragment 2 (amino acids 1321-1663 of SEQ ID NO:47). Cleavage sequences in complement protein C3 are set forth in Table 10 below, which lists the P4-P1 residues, the amino acid residues of the cleavage site (P1-P1' site) and the protease responsible for cleavage. The modified u-PA polypeptides provided herein do not cleave at these sites.

TABLE 10

Complement Protein C3 Cleavage Sequences

| P4-P1 Residues | Cleavage Site (in SEQ ID NO: 47) Between residues | Protease | SEQ ID NO. |
| --- | --- | --- | --- |
| GLAR | 748-749 | C3 convertase | 78 |
| RLGR | 954-955 | Factor I | 79 |
| LPSR | 1303-1304 | Factor I | 80 |
| SLLR | 1320-1321 | Factor I | 81 | a. C3a

C3a (amino acids 672-748 of SEQ ID NO:47) is an anaphylatoxin that is involved in inflammation, basophil and mast cell degranulation, enhanced vascular permeability, smooth muscle contraction and induction of suppressor T cells.

b. C3b

C3b (amino acids 749-1663 of SEQ ID NO:47) has various roles in the complement cascade. C3b is an opsonin that facilitates the uptake and destruction of pathogens by phagocytic cells. Additionally, C3b combines with the C3 convertases to generate the C5 convertases which activate complement protein C5 thereby generating the C5a anaphylatoxin and C5b, which combines with C6, C7, C8 and C9 to form the membrane attack complex. Furthermore, as described in section 1b above, C3b is involved in the alternative pathway of complement initiation. C3b is regulated by complement regulatory protein Factor I, a plasma protease which degrades C3b into various fragments, including iC3b, C3c, C3d, C3f and C3dg, thereby permanently inactivating C3b.

C3b plays a critical role in complement-mediated effector functions by virtue of its ability to bind to the C3 convertases C4b2b and C3bBb thereby generating the C5 convertases C4b2b3b and C3bBb3b. The C5 convertases cleave the zymogen C5 into its active fragments, namely the C5a anaphylatoxin and C5b. C5a is involved in chemotaxis and inflammation and C5b is involved in formation of MAC.

c. Inhibitors of C3b

C3b has binding sites for various complement components including C5, properdin (P), factors H, B and I, complement receptor 1 (CR1) and the membrane co-factor protein (MCP) (see Sahu and Lambris (2001) *Immunological Reviews* 180:35-48). Binding of factor I, a plasma protease, in the presence of cofactors H, CR1 and MCP results in inactivation of C3b whereas binding of factors B and P in the presence of factor D results in amplification of C3 convertase and initiation of MAC. Factor I cleaves C3b in the presence of cofactors between residues 1303-1304, 1320-1321 and 954-955 of SEQ ID NO:47 generating fragments iC3b (amino acids 749-1303 of SEQ ID NO:47) and C3f (amino acids 1304-1320 of SEQ ID NO:47). Although technically not considered an anaphylatoxin, iC3b, an inactive derivative of C3b, functions to induce leukocyte adhesion to the vascular endothelium and induce the production of the pro-inflammatory cytokine IL-1 via binding to its cell surface integrin receptors. The protein iC3b functions as an opsonin. Factor I subsequently cleaves iC3b generating fragments C3c (C3c alpha' chain Fragment 1: amino acids 749-954 of SEQ ID NO:47 and C3c alpha' chain Fragment 2: amino acids 1321-1663 of SEQ ID NO:47) and C3dg (amino acids 955-1303 of SEQ ID NO:47). The end result is that C3b is permanently inactivated (see Sahu and Lambris (2001) *Immunological Reviews* 180:35-48). C3dg can be further cleaved to generate fragments C3g (amino acids 955-1001 of SEQ ID NO: 47) and C3d (amino acids 1002-1303 of SEQ ID NO:47).

D. MODIFIED U-PA POLYPEPTIDES THAT CLEAVE C3

Provided herein are modified or variant urokinase-type plasminogen activator (u-PA) polypeptides. Also provided are conjugates, such as fusion proteins, that contain modified u-PA polypeptides, so that resulting activated forms thereof cleave C3. The modified u-PA polypeptides provided herein exhibit altered activities or properties compared to a wild-type, native or reference u-PA polypeptide. For example, the u-PA polypeptides provided herein contain modifications compared to a wild-type, native or reference u-PA polypeptide set forth in any of SEQ ID NOS:1-6, or in a polypeptide that has at least 65%, 70%, 75%, 80%, 85%, 86%, 87%, 88%, 89%, 90%, 91%, 92%, 93%, 94%, 95%, 96%, 97%, 98%, or 99%, particularly at least 95% sequence identity to any of SEQ ID NOS:1-6, such as the reference u-PA protease domain set forth in SEQ ID NO:5. Included among the modified u-PA polypeptides provided herein are u-PA polypeptides that alter (inhibit) complement activation by effecting inhibitory cleavage of complement protein C3. Among the modified u-PA polypeptides provided herein are those that effect inhibitory cleavage of complement protein C3. Included are those that effect inhibitory cleavage of C3 with greater activity or specificity, $K_{cat}/K_m$, compared to a corresponding form of the u-PA that does not contain the modification (the replacement, deletion and/or insertion) or compared to the corresponding form of unmodified u-PA whose sequences are set forth in any of SEQ ID NOs:1-6. The modified u-PA polypeptides also can have decreased specificity and/or and selectivity for substrates and targets cleaved or recognized by unmodified u-PA, including cleavage of plasminogen and/or binding to uPAR, compared to the corresponding u-PA polypeptide not containing the amino acid modification(s).

The modified u-PA polypeptides provided herein inhibit or inactivate complement through inhibitory or inactivation cleavage of complement protein C3. The modified u-PA polypeptides provided herein inhibit or inactivate complement by cleaving complement protein C3 at a cleavage site that results in inhibition or inactivation of C3. Inactivation or inhibition cleavage of complement protein C3 can be at any sequence in C3 so long as the resulting cleavage of C3 results in inactivation or inhibition of activation of complement. Since the modified u-PA polypeptides provided herein inhibit complement activation, the modified u-PA polypeptides do not effect cleavage of the zymogen form of C3 to generate the C3a and C3b activated fragments. Thus, modified u-PA polypeptides provided herein do not cleave C3 between residues 748-749 of SEQ ID NO: 47, which would result in generation of C3a and C3b. Inhibition or inactivation cleavage sites of complement protein C3 can be empirically determined or identified. If necessary, a modified u-PA polypeptide can be tested for its ability to inhibit complement as described in section E below and as exemplified in the Examples.

The modified u-PA polypeptides provided herein catalyze inhibitory or inactivation cleavage of complement protein C3. The modified u-PA polypeptides provided herein cleave complement protein C3 at any cleavage sequence as long as the resulting C3 fragments are inactive, or unable to activate a complement-mediated effector function. The modified u-PA polypeptides provided herein have altered (i.e., decreased) specificity and/or selectivity for natural targets of u-PA, including plasminogen and uPAR. In one example, the modified u-PA polypeptides provided herein have reduced specificity for cleavage of plasminogen. In another example, the modified u-PA polypeptides provided herein have reduced selectivity for binding to uPAR. In some examples, the modified u-PA polypeptides provided herein have reduced specificity for cleavage of plasminogen and reduced selectivity for binding to uPAR. In other examples, the modified u-PA polypeptides provided herein have increased specificity for cleavage of complement protein C3 and decreased specificity for cleavage of plasminogen. In other examples, the modified u-PA polypeptides provided herein have increased selectivity for complement protein C3 and decreased selectivity for plasminogen and/or uPAR.

The modified u-PA polypeptides provided herein and described in the examples are, for example, isolated protease domains of u-PA. Smaller portions thereof that retain protease activity also are contemplated. The modified u-PA polypeptides provided herein are mutants of the protease domain of u-PA, particularly modified u-PA polypeptides in which the Cys residue in the protease domain that is free (i.e., does not form disulfide linkages with any other Cys residue in the protein) is substituted with another amino acid substitution, preferably with a conservative amino acid substitution or a substitution that does not eliminate the activity, such as, for example, substitution with Serine, and modified u-PA polypeptides in which a glycosylation site(s) is eliminated. Modified u-PA polypeptides in which other conservative amino acid substitutions in which catalytic activity is retained are also contemplated (see e.g., Table 3, for exemplary amino acid substitutions).

The modified u-PA polypeptides provided herein contain one or more amino acid modifications such that they cleave complement protein C3 in a manner that results in inactivation or inhibition of complement. The modifications can be a single amino acid modification, such as single amino acid replacements (substitutions), insertions or deletions, or multiple amino acid modifications, such as multiple amino acid replacements, insertions or deletions. Exemplary modifications are amino acid replacements, including single or multiple amino acid replacements. The amino acid replacement can be a conservative substitution, such as set forth in Table 3, or a non-conservative substitution, such as any described herein. Modified u-PA polypeptides provided herein can contain at least or 1, 2, 3, 4, 5, 6, 7, 8, 9, 10, 11, 12, 13, 14, 15, 16, 17, 18, 19, 20, or more modified positions compared to the u-PA polypeptide not containing the modification.

The modifications described herein can be made in any u-PA polypeptide. For example, the modifications are made in a human u-PA polypeptide having a sequence of amino acids including or set forth in SEQ ID NO:1, SEQ ID NO:2, SEQ ID NO:3, SEQ ID NO:4, SEQ ID NO: 5 or SEQ ID NO:6, or allelic variants thereof, a mouse u-PA polypeptide having a sequence of amino acids including or set forth in SEQ ID NOS:52 or 66; a rat u-PA polypeptide having a sequence of amino acids including or set forth in SEQ ID NOS:53 or 67; a cow u-PA polypeptide having a sequence of amino acids including or set forth in SEQ ID NOS:54 or 68; a porcine u-PA polypeptide having a sequence of amino acids including or set forth in SEQ ID NOS:55 or 69; a rabbit u-PA polypeptide having a sequence of amino acids including or set forth in SEQ ID NOS:56 or 70; a chicken u-PA polypeptide having a sequence of amino acids including or set forth in SEQ ID NOS:57 or 71; a yellow baboon u-PA polypeptide having a sequence of amino acids including or set forth in SEQ ID NOS:58 or 72; a Sumatran orangutan u-PA polypeptide having a sequence of amino acids including or set forth in SEQ ID NOS:59 or 73; a dog u-PA polypeptide having a sequence of amino acids including or set forth in SEQ ID NOS:60 or 74; a ovine u-PA polypeptide having a sequence of amino acids including or set forth in SEQ ID NOS:61 or 75; a marmoset u-PA polypeptide having a sequence of amino acids including or set forth in SEQ ID NO:62; a rhesus monkey u-PA polypeptide having a sequence of amino acids including or set forth in SEQ ID NO:63; a northern white-cheeked gibbon u-PA polypeptide having a sequence of amino acids including or set forth in SEQ ID NO:64; and a chimpanzee u-PA polypeptide having a sequence of amino acids including or set forth in SEQ ID NOS:65; or in sequence variants or catalytically active fragments that exhibit at least 65%, 70%, 75%, 80%, 85%, 86%, 87%, 88%, 89%, 90%, 91%, 92%, 93%, 94%, 95%, 96%, 97%, 98%, 99% or more sequence identity to any of SEQ ID NOS:1-6 and 52-75.

The modified u-PA polypeptides provided herein can be modified in any region or domain of a u-PA polypeptide provided herein, as long as the modified u-PA polypeptide retains its ability to effect inactivation or inhibitory cleavage of complement protein C3. The modified u-PA polypeptides provided herein can be single-chain or two chain polypeptides, species variants, allelic variants, isoforms, or catalytically active fragments thereof, such as, for example, the protease domain thereof. The u-PA polypeptides provided herein can be full length or truncated u-PA polypeptides. The modified u-PA polypeptides provided herein can be the protease domain of u-PA or a modified form of the protease domain of u-PA. Also contemplated for use herein are zymogen, precursor or mature forms of modified u-PA polypeptides, provided the u-PA polypeptides retain their ability to effect inhibitory or inactivation cleavage of complement protein C3. Modifications in a u-PA polypeptide also can be made to a u-PA polypeptide that also contains other modifications, including modifications of the primary sequence and modifications not in the primary sequence of the polypeptide. For example, a modification described herein can be in a u-PA polypeptide that is a fusion polypeptide or chimeric polypeptide. The modified u-PA polypeptides provided herein also include polypeptides that are conjugated to a polymer, such as a PEG reagent.

For purposes herein, reference to positions and amino acids for modification, including amino acid replacement or replacements, herein are with reference to the u-PA polypeptide set forth in any of SEQ ID NOs:1-6. It is within the level of one of skill in the art to make any of the modifications provided herein in another u-PA polypeptide by identifying the corresponding amino acid residue in another u-PA polypeptide, such as the u-PA polypeptide set forth in any of SEQ ID NOs:1-6 or a variant thereof that exhibits at least 70%, 75%, 80%, 85%, 86%, 87%, 88%, 89%, 90%, 91%, 92%, 93%, 94%, 95%, 96%, 97%, 98%, 99% or more sequence identity to a u-PA polypeptide set forth in any of SEQ ID NOs:1-6. Corresponding positions in another u-PA polypeptide can be identified by alignment of the u-PA polypeptide with the reference a u-PA polypeptide set forth in any of SEQ ID NOs:1-6. For purposes of modification (e.g. amino acid replacement), the corresponding amino acid residue can be any amino acid residue, and need not be identical to the residue set forth in any of SEQ ID NOs:1-6. Typically, the corresponding amino acid residue identified by alignment with, for example, residues in SEQ ID NO:5 is an amino acid residue that is identical to SEQ ID NO:5, or is a conservative or semi-conservative amino acid residue thereto. It also is understood that the exemplary replacements provided herein can be made at the corresponding residue in a u-PA polypeptide, such as the protease domain of u-PA, so long as the replacement is different than exists in the unmodified form of the u-PA polypeptide, such as the protease domain of u-PA. Based on this description and the description elsewhere herein, it is within the level of one of skill in the art to generate a modified u-PA polypeptide containing any one or more of the described mutations, and test each for a property or activity as described herein.

The modified u-PA polypeptides provided herein alter complement activity by proteolysis-mediated inhibition or inactivation of complement protein C3. Further, the modified u-PA polypeptides provided herein have decreased specificity for cleavage of plasminogen and/or binding to uPAR. For example, the modified u-PA polypeptides provided herein exhibit less than 100% of the wild type activity of a u-PA polypeptide for cleavage of plasminogen, such as less than 90%, 80%, 70%, 60%, 50%, 40%, 30%, 20%, 10% or less of the activity for cleavage of plasminogen of a wild type or reference u-PA polypeptide, such as the corresponding polypeptide not containing the amino acid modification. In another example, the modified u-PA polypeptides provided herein exhibit less than 100% of the wild type binding activity of a u-PA polypeptide for uPAR, such as less than 90%, 80%, 70%, 60%, 50%, 40%, 30%, 20%, 10% or less of the activity for binding to uPAR of a wild type or reference u-PA polypeptide, such as the corresponding polypeptide not containing the amino acid modification.

Also provided herein are nucleic acid molecules that encode any of the modified u-PA polypeptides provided herein. In some examples, the encoding nucleic acid molecules also can be modified to contain a heterologous signal sequence to alter (e.g. increased) expression and secretion of the polypeptide. The modified u-PA polypeptides and encoding nucleic acid molecules provided herein can be produced or isolated by any method known in the art including isolation from natural sources, isolation of recombinantly produced proteins in cells, tissues and organisms, and by recombinant methods and by methods including in silico steps, synthetic methods and any methods known to those of skill in the art. The modified polypeptides and encoding nucleic acid molecules provided herein can be produced by standard recombinant DNA techniques known to one of skill in the art. Any method known in the art to effect mutation of any one or more amino acids in a target protein can be employed. Methods include standard site-directed or random mutagenesis of encoding nucleic acid molecules, or solid phase polypeptide synthesis methods. For example, nucleic acid molecules encoding a u-PA polypeptide can be subjected to mutagenesis, such as random mutagenesis of the encoding nucleic acid, error-prone PCR, site-directed mutagenesis, overlap PCR, gene shuffling, or other recombinant methods. The nucleic acid encoding the polypeptides can then be introduced into a host cell to be expressed heterologously. Hence, also provided herein are nucleic acid molecules encoding any of the modified polypeptides provided herein. In some examples, the modified u-PA polypeptides are produced synthetically, such as using solid phase or solutions phase peptide synthesis. The nucleic acid molecules can be provided in gene therapy vectors, such as AAV or adenovirus vectors, for expression of the encoded modified u-PA polypeptide in vivo, such as in the eye or for systemic administration. The encoded u-PA polypeptide can be a full-length polypeptide or a protease domain or other form that is active or that can be activated.

The u-PA polypeptides provided herein have been modified to have increased specificity and/or selectivity for cleavage of an inhibitory or inactivation cleavage sequence of complement protein C3. u-PA polypeptides can be modified using any method known in the art for modification of proteins. Such methods include site-directed and random mutagenesis. Assays such as the assays for biological function of complement activation provided herein and known in the art can be used to assess the biological function of a modified u-PA polypeptide to determine if the modified u-PA polypeptide targets complement protein C3 for cleavage and inactivation. Exemplary methods to identify a u-PA polypeptide and the modified u-PA polypeptides are provided herein.

1. Exemplary Modified u-PA Polypeptides

Provided herein are modified u-PA polypeptides that contain one or more, including 2, 3, 4, 5, 6, 7, 8, 9, 10, 11, 12, 13, 14, 15 and more amino acid modifications in a u-PA polypeptide and that cleave complement protein C3 such that complement is inhibited or inactivated. Modifications are in the primary amino acid sequence, and include replacements, deletions and insertions of amino acid residues. The modification alter the specificity/activity of the u-PA polypeptide, when in an active form. The modified u-PA polypeptides herein are selected to recognize and cleave a target site in a complement protein, particularly C3 to inactivate it. They also can be further modified and screened to have reduced specificity/activity on in vivo substrates, such as plasminogen. They can be selected and identified by any suitable protease screen method. The modified u-PA polypeptides herein initially were identified using the screening method described in U.S. Pat. No. 8,211,428, in which a library of modified proteases are reacted with a cognate or other inhibitory serpin that is modified to include a target sequence in the reactive site loop to capture modified proteases that would cleave such target.

Modified u-PA polypeptides provided herein display increased activity or specificity or $K_{cat}/K_m$ for complement protein C3 at a site that inactivates C3, and also can have reduced activity or specificity for plasminogen and/or display increased selectivity, specificity and/or activity for a target site complement protein C3, whereby the modified u-PA polypeptide inactivates C3. The modified u-PA polypeptides exhibit increased activity for cleaving and inactivating C3 compared to the corresponding form of wild-type or wild-type with the replacement C122S (by chymotrypsin numbering). In particular, the protease domain of the modified u-PA polypeptide exhibits increased inactivation cleavage activity of C3 compared to the u-PA protease domain of SEQ ID NO:5 (u-PA protease domain with C122S). The increase in activity can be 10%, 20%, 50%, 100%, 1-fold, 2-fold, 3-fold, 4, 5, 6, 7, 8, 9, 10-fold and more compared to the unmodified u-PA.

The modified u-PA polypeptide can have reduced activity for a native substrate, such as plasminogen. For example, the modified u-PA polypeptides can exhibit 0 to 99% of the u-PA activity of a wild type or reference u-PA polypeptide, such as the u-PA polypeptide set forth in SEQ ID NO:5, for plasminogen and at least 0.5-fold, 1-fold, 2-fold, 3-fold or more for cleaving C3 to inactivate it. For example, modified u-PA polypeptides provided herein exhibit less than or less than about 99%, 95%, 90%, 80%, 70%, 60%, 50%, 40%, 30%, 20%, 10% or less of the u-PA activity of a wild type or reference u-PA polypeptide, such as the corresponding polypeptide not containing the amino acid modification (e.g. amino acid replacement), for example, a u-PA protease domain set forth in SEQ ID NO:5.

For example, exemplary positions that can be modified, for example by amino acid replacement or substitution, include, but are not limited to, any of positions corresponding to position 173, 178, 179, 180, 181, 185, 186, 187, 188, 208, 209, 249, 250, 252, 306, 314 or 353 with reference to the sequence of amino acids set forth in SEQ ID NO:3 (corresponding to positions 30, 35, 36, 37, 37a, 38, 39, 40, 41, 60a, 60b, 97a, 97b, 99, 149, 157 or 192 according to chymotrypsin numbering). For example, the amino acid positions can be replacements at positions corresponding to replacement of phenylalanine (F) at one or more of positions 173, R178, R179, H180, R181, V185, T186, Y187, V188, D208, Y209, T249, L250, H252, Y306, M314 or Q353 with reference to amino acid positions set forth in SEQ ID NO:3 (corresponding to F30, R35, R36, H37, R37a, V38, T39, Y40, V41, D60a, Y60b, T97a, L97b, H99, Y149, M157 and Q192, respectively according to chymotrypsin numbering).

Exemplary amino acid replacements at any of the above positions are set forth in Table 11. Reference to corresponding position in Table 11 is with reference to positions set forth in SEQ ID NO:3. (See, also the Examples, below). It is understood that the replacements can be made in the corresponding position in another u-PA polypeptide by alignment with the sequence set forth in SEQ ID NO:3, whereby the corresponding position is the aligned position. For example, the replacement can be made in the u-PA protease domain with the sequence set forth in SEQ ID NO: 2 or a reference u-PA protease domain with the sequence set forth in SEQ ID NO: 5. In some examples, the amino acid replacement(s) can be at the corresponding position in a u-PA polypeptide as set forth in SEQ ID NO: 5 or a variant thereof having at least or at least about 75%, 80%, 81%, 82%, 83%, 84%, 85%, 86%, 86%, 88%, 89%, 90%, 91%, 92%, 93%, 94%, 95%, 96%, 97%, 98%, 99%, particularly 95%, or more sequence identity thereto, so long as the resulting modified u-PA polypeptide exhibits altered (i.e., enhanced) specificity towards complement protein C3 compared to a u-PA activity towards plasminogen and/or an altered selectivity for complement protein C3. In one example, any one or more of the replacements are in any of SEQ ID NOs:1-6, so long as the resulting modified u-PA polypeptide exhibits altered (i.e., enhanced) specificity towards complement protein C3 compared to a u-PA activity towards plasminogen and/or an altered selectivity for complement protein C3.

TABLE 11

Exemplary mutations that result in increased activity for cleavage of C3

| Corresponding Position (in SEQ ID NO: 3) | Corresponding Position (chymotrypsin numbering) | Replacement |
|---|---|---|
| 173 | 30 | Y |
| 178 | 35 | W Y Q |
| 179 | 36 | H |
| 180 | 37 | E P D N G K Y |
| 181 | 37a | Q P E N S |
| 185 | 38 | D E |
| 186 | 39 | W Y F |
| 187 | 40 | H F Q |
| 188 | 41 | R L |
| 208 | 60a | P T |
| 209 | 60b | Q H S A T L |
| 249 | 97a | E I |
| 250 | 97b | A G |
| 252 | 99 | Q |
| 279 | 122 | S |
| 306 | 149 | K R |
| 314 | 157 | K |
| 353 | 192 | H |

Exemplary of amino acid modifications in the modified u-PA polypeptides provided herein include, but are not limited to, replacement with tyrosine (Y) at a position corresponding to position 173 (30 by chymotrypsin numbering); W at a position corresponding to position 178 (35 by chymotrypsin numbering); Y at a position corresponding to position 178; Q at a position corresponding to position 178; H at a position corresponding to position 179 (36 by chymotrypsin numbering); E at a position corresponding to position 180 (37 by chymotrypsin numbering); P at a position corresponding to position 180; D at a position corresponding to position 180; N at a position corresponding to position 180; G at a position corresponding to position 180; K at a position corresponding to position 180; Y at a position corresponding to position 180; Q at a position corresponding to position 181 (37a by chymotrypsin numbering); P at a position corresponding to position 181; E at a position corresponding to position 181; N at a position corresponding to position 181; S at a position corresponding to position 181; D at a position corresponding to position 185 (38 by chymotrypsin numbering); E at a position corresponding to position 185; W at a position corresponding to position 186 (39 by chymotrypsin numbering); Y at a position corresponding to position 186; F at a position corresponding to position 186; H at a position corresponding to position 187 (40 by chymotrypsin numbering); F at a position corresponding to position 187; Q at a position corresponding to position 187; R at a position corresponding to position 188 (41 by chymotrypsin numbering); L at a position corresponding to position 188; P at a position corresponding to position 208; T at a position corresponding to position 208 (60a by chymotrypsin numbering); Q at a position corresponding to position 209 (60b by chymotrypsin numbering); H at a position corresponding to position 209; S at a position corresponding to position 209; A at a position corresponding to position 209; T at a position corresponding to position 209; L at a position corresponding to position 209; E at a position corresponding to position 249 (97a by chymotrypsin numbering); I at a position corresponding to position 249; A at a position corresponding to position 250 (97b by chymotrypsin numbering); G at a position corresponding to position 250; Q at a position corresponding to position 252 (99 by chymotrypsin numbering); K at a position corresponding to position 306 (149 by chymotrypsin numbering); R at a position corresponding to position 306; K at a position corresponding to position 314 (157 by chymotrypsin numbering); or H at a position corresponding to position 353 (192 by chymotrypsin numbering); each with reference to the amino acid positions set forth in SEQ ID NO:3. S at a position corresponding to position 279 (122S) by chymotrypsin numbering) replaces a free Cys to thereby reduce a tendency for aggregation.

Exemplary modified u-PA polypeptides containing 2 or more amino acid modifications are set forth in Table 12 below, and their activity for cleaving C3 is described in Table 14. The Sequence ID NO. references an exemplary u-PA protease domain that contains the recited replacements, which include the replacement at C122S to reduce or eliminate aggregation. C122 is a free cysteine, which can result in cross-linking among the protease polypeptides. It is understood that the protease domain is exemplary, and full-length and precursor molecules, as well as other catalytically active portions of the protease domain, full-length and precursor polypeptide can include the recited replacements, to form full-length activated modified u-PA polypeptides and other forms.

TABLE 12 modified u-PA polypeptides

| Mature u-PA numbering | Chymotrypsin numbering | Exemplary SEQ ID NO |
|---|---|---|
| F173Y/V185D/Y187H/V188R/L250A/H252Q/C279S/M314K | F30Y/V38D/Y40H/V41R/L97bA/H99Q/C122S/M157K | 8 |
| F173Y/R178W/R179H/H180E/V185E/T186W/Y187H/V188R/Y209Q/T249E/L250A/H252Q/C279S/Y306K/M314K | F30Y/R35W/R36H/H37E/V38E/T39W/Y40H/V41R/Y60bQ/T97aE/L97bA/H99Q/C122S/Y149K/M157K | 9 |
| F173Y/R178W/R179H/H180D/V185E/T186Y/Y187F/V188R/T249I/L250A/H252Q/C279S/Y306R/M314K | F30Y/R35W/R36H/H37D/V38E/T39Y/Y40F/V41R/T97aI/L97bA/H99Q/C122S/Y149R/M157K | 10 |
| R178W/R179H/H180N/V185E/T186F/Y187F/V188R/T249I/L250A/H252Q/C279S/Y306R/M314K/Q353H | R35W/R36H/H37N/V38E/T39F/Y40F/V41R/T97aI/L97bA/H99Q/C122S/Y149R/M157K/Q192H | 11 |
| F173Y/R178Y/R179H/H180K/V185E/T186F/Y187F/V188R/T249I/L250A/H252Q/C279S/Y306R/M314K | F30Y/R35Y/R36H/H37K/V38E/T39F/Y40F/V41R/T97aI/L97bA/H99Q/C122S/Y149R/M157K | 12 |
| F173Y/R178W/R179H/H180N/V185E/T186Y/Y187F/V188R/Y209S/T249E/L250A/H252Q/C279S/Y306K/M314K | F30Y/R35W/R36H/H37N/V38E/T39Y/Y40F/V41R/Y60bS/T97aE/L97bA/H99Q/C122S/Y149K/M157K | 13 |
| F173Y/R178W/R179H/H180P/V185E/T186Y/Y187F/V188R/Y209S/T249E/L250A/H252Q/C279S/Y306K/M314K | F30Y/R35W/R36H/H37P/V38E/T39Y/Y40F/V41R/Y60bS/T97aE/L97bA/H99Q/C122S/Y149K/M157K | 14 |
| V185E/Y187Q/V188L/Y209L/L250A/H252Q/C279S | V38E/Y40Q/V41L/Y60bL/L97bA/H99Q/C122S | 15 |
| F173Y/R178Q/R179H/H180G/R181E/V185E/T186F/Y187F/V188R/D208P/Y209S/T249I/L250A/H252Q/C279S/Y306R/M314K | F30Y/R35Q/R36H/H37G/R37aE/V38E/T39F/Y40F/V41R/D60aP/Y60bS/T97aI/L97bA/H99Q/C122S/Y149R/M157K | 16 |
| F173Y/R178Y/R179H/H180P/R181Q/V185E/T186Y/Y187F/V188R/Y209H/T249I/L250A/H252Q/C279S/Y306R/M314K | F30Y/R35Y/R36H/H37P/R37aQ/V38E/T39Y/Y40F/V41R/Y60bH/T97aI/L97bA/H99Q/C122S/Y149R/M157K | 17 |
| R178Q/H180Y/R181E/V185E/T186Y/V188R/D208T/Y209T/T249I/L250A/H252Q/C279S/Y306R | R35Q/H37Y/R37aE/V38E/T39Y/V41R/D60aT/Y60bT/T97aI/L97bA/H99Q/C122S/Y149R | 18 |
| R178W/H180P/R181N/V185E/T186Y/V188R/D208P/Y209L/T249I/L250A/H252Q/C279S/Y306R | R35W/H37P/R37aN/V38E/T39Y/V41R/D60aP/Y60bL/T97aI/L97bA/H99Q/C122S/Y149R | 19 |
| R178W/H180D/R181P/V185E/T186W/V188R/Y209A/T249I/L250A/H252Q/C279S/Y306R | R35W/H37D/R37aP/V38E/T39W/V41R/Y60bA/T97aI/L97bA/H99Q/C122S/Y149R | 20 |
| R178Q/H180Y/R181E/V185E/T186Y/V188R/D208P/Y209Q/T249I/L250A/H252Q/C279S/Y306R | R35Q/H37Y/R37aE/V38E/T39Y/V41R/D60aP/Y60bQ/T97aI/L97bA/H99Q/C122S/Y149R | 21 |
| H180Y/R181E/V185E/T186Y/V188R/D208P/Y209Q/T249I/L250A/H252Q/C279S/Y306R | H37Y/R37aE/V38E/T39Y/V41R/D60aP/Y60bQ/T97aI/L97bA/H99Q/C122S/Y149R | 22 |

TABLE 12-continued modified u-PA polypeptides

| Mature u-PA numbering | Chymotrypsin numbering | Exemplary SEQ ID NO |
|---|---|---|
| R178Q/R181E/V185E/T186Y/V188R/D208P/ Y209Q/T249I/L250A/H252Q/C279S/ Y306R | R35Q/R37aE/V38E/T39Y/V41R/D60aP/ Y60bQ/T97aI/L97bA/H99Q/C122S/ Y149R | 23 |
| R178Q/H180Y/V185E/T186Y/V188R/D208P/ Y209Q/T249I/L250A/H252Q/C279S/ Y306R | R35Q/H37Y/V38E/T39Y/V41R/D60aP/ Y60bQ/T97aI/L97bA/H99Q/C122S/ Y149R | 24 |
| R178Q/H180Y/R181E/T186Y/V188R/D208P/ Y209Q/T249I/L250A/H252Q/C279S/ Y306R | R35Q/H37Y/R37aE/T39Y/V41R/D60aP/ Y60bQ/T97aI/L97bA/H99Q/C122S/ Y149R | 25 |
| R178Q/H180Y/R181E/V185E/V188R/D208P/ Y209Q/T249I/L250A/H252Q/C279S/ Y306R | R35Q/H37Y/R37aE/V38E/V41R/D60aP/ Y60bQ/T97aI/L97bA/H99Q/C122S/ Y149R | 26 |
| R178Q/H180Y/R181E/V185E/T186Y/D208P/ Y209Q/T249I/L250A/H252Q/C279S/ Y306R | R35Q/H37Y/R37aE/V38E/T39Y/D60aP/ Y60bQ/T97aI/L97bA/H99Q/C122S/ Y149R | 27 |
| R178Q/H180Y/R181E/V185E/T186Y/V188R/ Y209Q/T249I/L250A/H252Q/C279S/ Y306R | R35Q/H37Y/R37aE/V38E/T39Y/V41R/ Y60bQ/T97aI/L97bA/H99Q/C122S/ Y149R | 28 |
| R178Q/H180Y/R181E/V185E/T186Y/V188R/ D208P/T249I/L250A/H252Q/C279S/ Y306R | R35Q/H37Y/R37aE/V38E/T39Y/V41R/ D60aP/T97aI/L97bA/H99Q/C122S/ Y149R | 29 |
| R178Q/H180Y/R181E/V185E/T186Y/V188R/ D208P/Y209Q/L250A/H252Q/C279S/ Y306R | R35Q/H37Y/R37aE/V38E/T39Y/V41R/ D60aP/Y60bQ/L97bA/H99Q/C122S/ Y149R | 30 |
| R178Q/H180Y/R181E/V185E/T186Y/V188R/ D208P/Y209Q/T249I/H252Q/C279S/ Y306R | R35Q/H37Y/R37aE/V38E/T39Y/V41R/ D60aP/Y60bQ/T97aI/H99Q/C122S/ Y149R | 31 |
| R178Q/H180Y/R181E/V185E/T186Y/V188R/ D208P/Y209Q/T249I/L250A/C279S/ Y306R | R35Q/H37Y/R37aE/V38E/T39Y/V41R/ D60aP/Y60bQ/T97aI/L97bA/C122S/ Y149R | 32 |
| R178Q/H180Y/R181E/V185E/T186Y/V188R/ D208P/Y209Q/T249I/L250A/H252Q/ C279S | R35Q/H37Y/R37aE/V38E/T39Y/V41R/ D60aP/Y60bQ/T97aI/L97bA/H99Q/ C122S | 33 |
| Y187Q/V188L/Y209L/L250A/H252Q/ C279S | Y40Q/V41L/Y60bL/L97bA/H99Q/C122S | 34 |
| V185E/Y187Q/Y209L/L250A/H252Q/ C279S | V38E/Y40Q/Y60bL/L97bA/H99Q/C122S | 35 |
| V185E/Y187Q/V188L/L250A/H252Q/ C279S | V38E/Y40Q/V41L/L97bA/H99Q/C122S | 36 |
| V185E/Y187Q/V188L/Y209L/H252Q/ C279S | V38E/Y40Q/V41L/Y60bL/H99Q/C122S | 37 |
| V185E/Y187Q/V188L/Y209L/L250A/ C279S | V38E/Y40Q/V41L/Y60bL/L97bA/C122S | 38 |
| Y187Q/V188L/L250A/H252Q/C279S | Y40Q/V41L/L97bA/H99Q/C122S | 39 |
| Y187Q/V188L/L250A/C279S | Y40Q/V41L/L97bA/C122S | 40 |
| R181S/V188R/L250G/H252Q/C279S | R37aS/V41R/L97bG/H99Q/C122S | 41 |
| T186Y/V188R/L250A/H252Q/C279S | T39Y/V41R/L97bA/H99Q/C122S | 42 |
| T186Y/V188R/Y209Q/L250A/H252Q/C279S | T39Y/V41R/Y60bQ/L97bA/H99Q/C122S | 43 |
| T186Y/V188R/D208P/L250A/H252Q/C279S | T39Y/V41R/D60aP/L97bA/H99Q/C122S | 44 |

2. Additional Modifications

Any of the modified u-PA polypeptides provided herein can contain any one or more additional modifications. The additional modifications can include, for example, any amino acid substitution, deletion or insertion known in the art, typically any that increase specificity towards complement protein C3 compared to u-PA activity towards plasminogen and/or alter selectivity for complement protein C3. Also, contemplated are modifications that alter any other activity of interest. It is long known in the art that amino acid modifications of the primary sequence are additive (see, e.g., Wells (1990) Biochem 29:8509-8517). Any modified u-PA polypeptide provided herein can contain 1, 2, 3, 4, 5, 6, 7, 8, 9, 10, 11, 12, 13, 14, 15, 16, 17, 18, 19, 20 or more additional amino acid modifications to provide additional activities or alter activities.

Examples of additional modifications that can be included in the modified u-PA polypeptides provided herein include, but are not limited to, those described in U.S. Pat. Nos. 4,997,766; 5,126,134; 5,129,569; 5,275,946; 5,571,708; 5,580,559; 5,648,253; 5,728,564; 5,759,542; 5,811,252; 5,891,664; 5,932,213; 5,980,886; 6,248,712; 6,423,685; 7,070,925; 7,074,401; 7,807,457; 7,811,771; and 8,211,428; U.S. Patent Publication Nos. 2002/0106775; 2004/0265298; 2004/0146938; 2009/0010916; 2011/0055940; 2008/0020416; and 2006/0142195; International Patent Publication Nos. WO1988/008451; WO1989/010401; WO1990/004635; WO1996/013160; and WO 2002/40503; Petersen et al. (2001) Eur J Biochem 268:4430-4439; Skeldal et al. (2006) FEBS J 273:5143-5149; Sun et al. (1997) J Biol Chem 272:23818-23823; Blouse et al. (2009) J Biol Chem 284:4647-4657; Nelles et al. (1987) JBC 262:5682-5689; Crowley et al. (1993) Proc. Natl. Acad. Sci. U.S.A. 90:5021-5025; Zeslawska et al. (2000) J Mol Biol 301:465-475; Zeslawska et al. (2003) J Mol Biol 328:109-118; Quax et al. (1998) Arterioscler Thromb Vasc Biol 18:693-701; Homandberg and Wai (1990) *Thrombin Res* 58:403-412; Zaitsev et al. (2010) *Blood* 115:5241-5248; Yang et al. (1994) *Biochemistry* 33:606-612; Davidow et al. (1991) *Protein Eng* 4:923-928; Boutad and Castellino (1993) *Arch Biochem Biophys* 303:222-230; Tsujikawa et al. (1996) *Yeast* 12:541-553; Carriero et al. (2002) *Biol Chem* 383:107-113; Stopelli et al. (1985) *Proc. Natl. Acad. Sci. U.S.A.* 82:4939-4943; Stoppelli et al. (1987) *J Biol Chem* 262:4437-4440; Franco et al. (1998) *J Biol Chem* 273:27734-27740; Franco et al. (1997) *J Cell Biol* 137:779-791; Li et al. (1995) *J Biol Chem* 270:30282-30285; Botkjaer et al. (2009) *Biochemistry* 48:9606-9617; Bdeir et al. (2003) *Blood* 102:3600-3608; Eguchi et al. (1990) *J Biochem* 108:72-79; Miyake et al. (1988) *J Biochem* 104:643-647; Bergstrom et al. (2003) *Biochem* 42:5395-5402; Sun and Liu (2005) *Proteins* 61:870-877; Sun et al. (1998) *Biochemistry* 37:2935-2940; Anderson et al. (2008) *Biochem J*412:447-457; Li et al. (1992) *Biochim Biophys Acta* 1159:37-43; Lijnen et al. (1988) *Eur J Biochem* 177:575-582; Lijnen et al. (1988) *Eur J Biochem* 172:185-188; Lijnen et al. (1992) *Eur J Biochem* 205:701-709; Lijnen et al. (1994) *Eur J Biochem* 224:567-574; Lijnen et al. (1990) *J Biol Chem* 265:5232-5236; Yoshimoto et al. (1996) *Biochim Biophys Acta* 1293:83-89; Magdolen et al. (1996) *Eur J Biochem* 237:743-751; Nienaber et al. (2000) *J Biol Chem* 275:7239-7248; Gurewich et al. (1988) *J Clin Invest* 1956-1962; Liu et al. (1996) *Biochemistry* 35:14070-14076; Liu et al. (2002) *Circ Res* 90:757-763; Mukhina et al. (2000) *J Biol Chem* 275:16450-16458; Peng et al. (1997) *Biochem Mol Biol Int* 41:887-894; Turkmen et al. (1997) *Electrophoresis* 18:686-689; Peng et al. (1999) *Biotechnol Lett* 21:979-985; Ueshima et al. (1994) *Thromb Haemost* 71:134-140; and Melnick et al. (1990) *J Biol Chem* 265:801-807. Non-limiting examples of exemplary amino acid modifications described in the art include any one or more of S9A, C13A, T18A, C19A, V20A, S21A, N22Y, N22A, N22Q, N22R, K23A, K23H, K23Q, K23E, Y24A, F25A, S26A, S26F, N27A, N27R, I28A, H29A, H29R, W30A, W30R, W30F, N32S, K35A, G38R, E43A, I44A, D45A, K46A, S47A, S47G, K48A, K48P, T49A, Y51A, N54A, L80H, Q81R, Q82P, T83R, H99Y, P105A, D106A, N107A, R108A, R108D, R109A, R110A, G118N, L119R, K120R, K120A, P121L, L122T, L122R, V123Y, V123W, Q124A, E125A, H129A, D130G, C131W, K135G, K135S, K135Y, K135Q, K136P, S138E, C148S, C148A, K151E, T152A, R154G, R154P, R154A, P155R, P155L, P155A, P155N, P155S, P155G, P155Q, R156P, R156A, R156H, R156S, R156Y, R156E, R156G, R156L, F157L, F157T, F157G, F157Q, F157D, F157E, K158R, K158E, K158A, K158H, K158S, K158Y, K158G, K158W, K158V, K158M, I159R, I159A, I159P, I159G, I160A, I160K, G162R, E163A, F164V, F164A, F164V, I167L, P171L, F173I, F173V, F173L, F173T, F173G, F173M, A175S, Y177A, R178A, R179A, H180A, R181A, S184A, T186A, T186E, T186D, Y187A, Y187H, V188A, S192N, I194M, S195A, H204A, H204Q, F206A, D208A, Y209A, P210A, K211A, K211Q, K212A, E213A, D214A, Y215A, I216A, Y218A, R221A, S222L, R223G, R223A, L224A, L224P, N225A, S226P, N227A, Q229A, E231G, K233E, K233A, F234A, E235K, E235A, E237A, I240V, K243E, K243A, D244A, Y245A, D255A, R262A, K264A, E265A, R267A, C268Y, C279S, C279A, F289L, G290D, E294G, I295T, G297D, F298A, G299A, G299H, K300A, K300H, K300W, E301D, E301A, E301H, N302A, N302Q, N302V, N302L, N302I, N302S, N302T, S303E, S303A, S303E, T304A, T304V, T304M, D305A, Y306A, Y306G, Y306V, Y306H, L307A, Y308A, P309A, P309S, P309T, P309V, P309G, P309N, P309L, P309D, P309R, P309H, P309F, P309W, E310A, Q311A, L312P, L312V, L312M, K313Y, K313T, K313A, K313H, T315A, T315I, V316A, V317A, Y330H, A343T, D344A, Q346A, W347A, K348A, K348E, T3491, D350A, S351A, Q353A, G354R, D355A, S356A, G357E, G366C, R378C, R378A, K383A, K385A, R400A, H402A, K404A, E405A, E406A G408A, or A410V, according to the sequence of amino acids set forth in SEQ ID NO:3. Additional modifications include amino acid replacements that introduce a glycosylation site.

The modified u-PA polypeptides include those that contain chemical or post-translational modifications. In some examples, modified u-PA polypeptides provided herein do not contain chemical or post-translational modifications. Chemical and post-translational modifications include, but are not limited to, pegylation, sialation, albumination, glycosylation, farnysylation, carboxylation, hydroxylation, PASylation, HESylation, phosphorylation, linkage to a multimerization domain(s), such as Fc, and other polypeptide modifications known in the art. In addition to any one or more amino acid modifications, such as amino acid replacements, insertions, deletions, and combinations thereof, provided herein, modified u-PA polypeptides provided herein can be conjugated or fused to any moiety using any method known in the art, including chemical and recombinant methods, providing the resulting polypeptide, when in active form, retains the ability to effect inhibitory or inactivation cleavage of complement protein C3.

For example, in addition to any one or more amino acid modifications, such as amino acid replacements provided herein, modified u-PA polypeptides provided herein also can contain other modifications that are or are not in the primary sequence of the polypeptide, including, but not limited to, modification with a carbohydrate moiety, a polyethylene glycol (PEG) moiety, a sialylation moiety, an Fc domain from immunoglobulin G, or any other domain or moiety. For example, such additional modifications can be made to increase the stability or serum half-life of the protein.

a. Decreased Immunogenicity

The modified u-PA polypeptides provided herein can be modified to have decreased immunogenicity. Decreased immunogenicity can be effected by sequence changes that eliminate antigenic epitopes from the polypeptide or by altering post-translational modifications. One of skill in the art is familiar with methods of identifying antigenic epitopes in a polypeptide (see e.g. Liang et al. (2009) *BMC Bioinformatics,* 10:302; Yang et al. (2009) *Rev. Med. Virol.,* 19:77-96). In some examples, one or more amino acids can be modified in order to remove or alter an antigenic epitope. In another example, altering the glycosylation of a protein also can affect immunogenicity. For example, altering the glycosylation of the peptide is contemplated, so long as the polypeptides retain the ability to effect inhibitory or inactivation cleavage of complement protein C3. Glycosylation sites can be removed by single mutations. Glycosylation sites can be added by introducing a canonical sequence, such as by insertion or single or a plurality of mutations, such as NXS(T), where X is not a proline. Glycosylation sites also can increase serum half-life.

b. Fc Domain

The modified u-PA polypeptides can be linked to the Fc region of an immunoglobulin polypeptide. Typically, such a fusion retains at least a functionally active hinge, $C_H2$ and $C_H3$ domains of the constant region of an immunoglobulin heavy chain. For example, a full-length Fc sequence of IgG1 includes amino acids 99-330 of the sequence set forth in the SEQ ID NO: 45 below.

Ala Ser Thr Lys Gly Pro Ser Val Phe Pro Leu Ala Pro Ser Ser Lys
1               5                   10                  15
Ser Thr Ser Gly Gly Thr Ala Ala Leu Gly Cys Leu Val Lys Asp Tyr
        20              25                  30
Phe Pro Glu Pro Val Thr Val Ser Trp Asn Ser Gly Ala Leu Thr Ser
            35              40              45
Gly Val His Thr Phe Pro Ala Val Leu Gln Ser Ser Gly Leu Tyr Ser
        50              55              60
Leu Ser Ser Val Val Thr Val Pro Ser Ser Ser Leu Gly Thr Gln Thr
65              70              75              80
Tyr He Cys Asn Val Asn His Lys Pro Ser Asn Thr Lys Val Asp Lys
                85              90              95
Lys Val Glu Pro Lys Ser Cys Asp Lys Thr His Thr Cys Pro Pro Cys
            100             105             110
Pro Ala Pro Glu Leu Leu Gly Gly Pro Ser Val Phe Leu Phe Pro Pro
        115             120             125
Lys Pro Lys Asp Thr Leu Met He Ser Arg Thr Pro Glu Val Thr Cys
    130             135             140
Val Val Val Asp Val Ser His Glu Asp Pro Glu Val Lys Phe Asn Trp
145             150             155             160
Tyr Val Asp Gly Val Glu Val His Asn Ala Lys Thr Lys Pro Arg Glu
                165             170             175
Glu Gln Tyr Asn Ser Thr Tyr Arg Val Val Ser Val Leu Thr Val Leu
            180             185             190
His Gln Asp Trp Leu Asn Gly Lys Glu Tyr Lys Cys Lys Val Ser Asn
        195             200             205
Lys Ala Leu Pro Ala Pro He Glu Lys Thr He Ser Lys Ala Lys Gly
    210             215             220
Gln Pro Arg Glu Pro Gln Val Tyr Thr Leu Pro Pro Ser Arg Asp Glu
225             230             235             240
Leu Thr Lys Asn Gln Val Ser Leu Thr Cys Leu Val Lys Gly Phe Tyr
                245             250             255
Pro Ser Asp He Ala Val Glu Trp Glu Ser Asn Gly Gln Pro Glu Asn
            260             265             270
Asn Tyr Lys Thr Thr Pro Pro Val Leu Asp Ser Asp Gly Ser Phe Phe
        275             280             285
Leu Tyr Ser Lys Leu Thr Val Asp Lys Ser Arg Trp Gln Gln Gly Asn
    290             295             300
Val Phe Ser Cys Ser Val Met His Glu Ala Leu His Asn His Tyr Thr
305             310             315             320
Gln Lys Ser Leu Ser Leu Ser Pro Gly Lys.
                325             330

An exemplary Fc sequence for hIgG1 is set forth in SEQ ID NO: 50:

Pro Lys Ser Cys Asp Lys Thr His Thr Cys Pro Pro Cys Pro Ala Pro
1               5                   10                  15
Glu Leu Leu Gly Gly Pro Ser Val Phe Leu Phe Pro Pro Lys Pro Lys
        20              25                  30
Asp Thr Leu Met He Ser Arg Thr Pro Glu Val Thr Cys Val Val Val
            35              40              45
Asp Val Ser His Glu Asp Pro Glu Val Lys Phe Asn Trp Tyr Val Asp
        50              55              60

-continued

```
Gly Val Glu Val His Asn Ala Lys Thr Lys Pro Arg Glu Glu Gln Tyr
65              70                  75                  80

Asn Ser Thr Tyr Arg Val Val Ser Val Leu Thr Val Leu His Gln Asp
                85              90                  95

Trp Leu Asn Gly Lys Glu Tyr Lys Cys Lys Val Ser Asn Lys Ala Leu
            100                 105                 110

Pro Ala Pro Ile Glu Lys Thr Ile Ser Lys Ala Lys Gly Gln Pro Arg
        115                 120                 125

Glu Pro Gln Val Tyr Thr Leu Pro Pro Ser Arg Glu Glu Met Thr Lys
    130                 135                 140

Asn Gln Val Ser Leu Thr Cys Leu Val Lys Gly Phe Tyr Pro Ser Asp
145                 150                 155                 160

Ile Ala Val Glu Trp Glu Ser Asn Gly Gln Pro Glu Asn Asn Tyr Lys
                165                 170                 175

Thr Thr Pro Pro Val Leu Asp Ser Asp Gly Ser Phe Phe Leu Tyr Ser
            180                 185                 190

Lys Leu Thr Val Asp Lys Ser Arg Trp Gln Gln Gly Asn Val Phe Ser
        195                 200                 205

Cys Ser Val Met His Glu Ala Leu His Asn His Tyr Thr Gln Lys Ser
    210                 215                 220

Leu Ser Leu Ser Pro Gly Lys
225         230
```

It contains almost all of the hinge sequence corresponding to amino acids 100-110 of SEQ ID NO:45; the complete sequence for the $C_H2$ and $C_H3$ domain as set forth in SEQ ID NO:45.

Another exemplary Fc polypeptide is set forth in PCT application Publication No. WO 93/10151, and is a single chain polypeptide extending from the N-terminal hinge region to the native C-terminus of the Fc region of a human IgG1 antibody (SEQ ID NO:50). The precise site at which the linkage is made is not critical: particular sites are well known and can be selected in order to optimize the biological activity, secretion, or binding characteristics of the HABP polypeptide. For example, other exemplary Fc polypeptide sequences begin at amino acid C109 or P113 of the sequence set forth in SEQ ID NO: 45 (see e.g., U.S. Pub. No. 2006/0024298).

In addition to hIgG1 Fc, other Fc regions and other multimerization domains also can be used. For example, where effector functions mediated by Fc/FcγR interactions are to be minimized, fusion with IgG isotypes that poorly recruit complement or effector cells, such as for example, the Fc of IgG2 or IgG4, is contemplated. Additionally, the Fc fusions can contain immunoglobulin sequences that are substantially encoded by immunoglobulin genes belonging to any of the antibody classes, including, but not limited to IgG (including human subclasses IgG1, IgG2, IgG3, or IgG4), IgA (including human subclasses IgA1 and IgA2), IgD, IgE, and IgM classes of antibodies. Linkers can be used to covalently link Fc to another polypeptide to generate an Fc chimera.

Modified Fc domains also are well known. In some examples, the Fc region is modified such that it exhibits altered binding to an FcR to result in altered (i.e. more or less) effector function than the effector function of an Fc region of a wild-type immunoglobulin heavy chain. Thus, a modified Fc domain can have altered affinity, including but not limited to, increased or low or no affinity for the Fc receptor. For example, the different IgG subclasses have different affinities for the FcγRs, with IgG1 and IgG3 typically binding substantially better to the receptors than IgG2 and IgG4. Different FcγRs mediate different effector functions. FcγR1, FcγRIIa/c, and FcγRIIIa are positive regulators of immune complex triggered activation, characterized by having an intracellular domain that has an immunoreceptor tyrosine-based activation motif (ITAM). FcγRIIb, however, has an immunoreceptor tyrosine-based inhibition motif (ITIM) and is therefore inhibitory. Altering the affinity of an Fc region for a receptor can modulate the effector functions and/or pharmacokinetic properties associated by the Fc domain. Modified Fc domains are known to one of skill in the art and described in the literature, see e.g. U.S. Pat. No. 5,457,035; U.S. Patent Publication No. US 2006/0024298; and International Patent Publication No. WO 2005/063816 for exemplary modifications.

The resulting chimeric polypeptides containing Fc moieties, and multimers formed therefrom, can be easily purified by affinity chromatography over Protein A or Protein G columns.

In another example, the modified u-PA polypeptide can be linked to human serum albumin (HSA), such as residues 25-608 of HSA, or the full length, or portion thereof:

```
          10         20         30         40
MKWVTFISLL FLFSSAYSRG VFRRDAHKSE VAHRFKDLGE 50         60         70         80
ENFKALVLIA FAQYLQQCPF EDHVKLVNEV TEFAKTCVAD 90        100        110        120
ESAENCDKSL HTLFGDKLCT VATLRETYGE MADCCAKQEP 130        140        150        160
ERNECFLQHK DDNPNLPRLV RPEVDVMCTA FHDNEETFLK 170        180        190        200
KYLYEIARRH PYFYAPELLF FAKRYKAAFT ECCQAADKAA
```

```
            210        220        230        240
       CLLPKLDELR DEGKASSAKQ GLKCASLQKF GERAFKAWAV 250        260        270        280
       ARLSQRFPKA EFAEVSKLVT DLTKVHTECC HGDLLECADD 290        300        310        320
       RADLAKYICE NQDSISSKLK ECCEKPLLEK SHCIAEVEND 330        340        350        360
       EMPADLPSLA ADFVGSKDVC KNYAEAKDVF LGMFLYEYAR 370        380        390        400
       RHPDYSVVLL LRLAKTYETT LEKCCAAADP HECYAKVFDE 410        420        430        440
       FKPLVEEPQN LIKQNCELFE QLGEYKFQNA LLVRYTKKVP 450        460        470        480
       QVSTPTLVEV SRNLGKVGSK CCKHPEAKRM PCAEDCLSVF 490        500        510        520
       LNQLCVLHEK TPVSDRVTKC CTESLVNGRP CFSALEVDET 530        540        550        560
       YVPKEFNAET FTFHADICTL SEKERQIKKQ TALVELVKHK 570        580        590        600
       PKATKEQLKA VMDDFAAFVE KCCKADDKET CFAEEGKKLV

AASQAALGL
``` c. Conjugation to Polymers

In some examples, the modified u-PA polypeptides provided herein are conjugated to other polymers. Polymers can increase the size of the polypeptide to reduce kidney clearance and thereby increase half-life or to modify the structure of the polypeptide to increase half-life or reduce immunogenicity. Exemplary polymers that can be conjugated to the u-PA polypeptides include natural and synthetic homopolymers, such as polyols (i.e. poly-OH), polyamines (i.e. poly-NH$_2$) and polycarboxylic acids (i.e. poly-COOH), and other heteropolymers i.e. polymers comprising one or more different coupling groups e.g. a hydroxyl group and amine groups. Examples of suitable polymeric molecules include polymeric molecules selected from among polyalkylene oxides (PAO), such as polyalkylene glycols (PAG), including polyethylene glycols (PEG), methoxypolyethylene glycols (mPEG) and polypropylene glycols, PEG-glycidyl ethers (Epox-PEG), PEG-oxycarbonylimidazole (CDI-PEG), branched polyethylene glycols (PEGs), polyvinyl alcohol (PVA), polycarboxylates, polyvinylpyrrolidone, poly-D,L-amino acids, polyethylene-co-maleic acid anhydride, polystyrene-co-maleic acid anhydride, dextrans including carboxymethyl-dextrans, heparin, homologous albumin, celluloses, including methylcellulose, carboxymethylcellulose, ethylcellulose, hydroxyethylcellulose, carboxyethylcellulose and hydroxypropylcellulose, hydrolysates of chitosan, starches such as hydroxyethyl-starches and hydroxypropyl-starches, glycogen, agaroses and derivatives thereof, guar gum, pullulan, inulin, xanthan gum, carrageenan, pectin, alginic acid hydrolysates and bio-polymers.

Typically, the polymers are polyalkylene oxides (PAO), such as polyethylene oxides, such as PEG, typically mPEG, which have few reactive groups capable of cross-linking. Typically, the polymers are non-toxic polymeric molecules such as (methoxy)polyethylene glycol (mPEG) which can be covalently conjugated to the u-PA polypeptides (e.g., to attachment groups on the protein surface) using a relatively simple chemistry.

Suitable polymeric molecules for attachment to the u-PA polypeptides include, but are not limited to, polyethylene glycol (PEG) and PEG derivatives such as methoxy-polyethylene glycols (mPEG), PEG-glycidyl ethers (Epox-PEG), PEG-oxycarbonylimidazole (CDI-PEG), branched PEGs, and polyethylene oxide (PEO) (see, e.g., Roberts et al., *Advanced Drug Delivery Review* 2002, 54: 459-476; Harris and Zalipsky (eds.) "Poly(ethylene glycol), Chemistry and Biological Applications" ACS Symposium Series 680, 1997; Mehvar et al., *J. Pharm. Pharmaceut. Sci.*, 3(1):125-136, 2000; Harris and Chess (2003) *Nat Rev Drug Discov.* 2(3):214-21; and Tsubery, *J Biol. Chem* 279(37):38118-24, 2004). The polymeric molecule can be of a molecular weight typically ranging from about 3 kDa to about 60 kDa. In some embodiments the polymeric molecule that is conjugated to a U-PA polypeptide provided herein has a molecular weight of 5, 10, 15, 20, 25, 30, 35, 40, 45, 50, 55, 60 or more than 60 kDa.

Methods of modifying polypeptides by covalently attaching (conjugating) a PEG or PEG derivative (i.e. "PEGylation") are well known in the art (see, e.g., U.S. 2006/0104968; U.S. Pat. Nos. 5,672,662; 6,737,505; and U.S. 2004/0235734). Techniques for PEGylation include, but are not limited to, specialized linkers and coupling chemistries (see, e.g., Harris, *Adv. Drug Deliv. Rev.* 54:459-476, 2002), attachment of multiple PEG moieties to a single conjugation site (such as via use of branched PEGs; see, e.g., Veronese et al., *Bioorg. Med. Chem. Lett.* 12:177-180, 2002), site-specific PEGylation and/or mono-PEGylation (see, e.g., Chapman et al., *Nature Biotech.* 17:780-783, 1999), and site-directed enzymatic PEGylation (see, e.g., Sato, *Adv. Drug Deliv. Rev.*, 54:487-504, 2002) (see, also, for example, Lu and Felix (1994) *Int. J. Peptide Protein Res.* 43:127-138; Lu and Felix (1993) *Peptide Res.* 6:142-6, 1993; Felix et al. (1995) *Int. J. Peptide Res.* 46:253-64; Benhar et al. (1994) *J. Biol. Chem.* 269:13398-404; Brumeanu et al. (1995) *J Immunol.* 154:3088-95; see also, Caliceti et al. (2003) *Adv. Drug Deliv. Rev.* 55(10):1261-77 and Molineux (2003) *Pharmacotherapy* 23 (8 Pt 2):3S-8S). Methods and techniques described in the art can produce proteins having 1, 2, 3, 4, 5, 6, 7, 8, 9, 10 or more than 10 PEG or PEG derivatives attached to a single protein molecule (see, e.g., U.S. 2006/0104968).

Numerous reagents for PEGylation have been described in the art. Such reagents include, but are not limited to, N-hydroxysuccinimidyl (NHS) activated PEG, succinimidyl mPEG, mPEG2-N-hydroxysuccinimide, mPEG succinimidyl alpha-methylbutanoate, mPEG succinimidyl propionate, mPEG succinimidyl butanoate, mPEG carboxymethyl 3-hydroxybutanoic acid succinimidyl ester, homobifunctional PEG-succinimidyl propionate, homobifunctional PEG propionaldehyde, homobifunctional PEG butyraldehyde, PEG maleimide, PEG hydrazide, p-nitrophenyl-carbonate PEG, mPEG-benzotriazole carbonate, propionaldehyde PEG, mPEG butryaldehyde, branched mPEG2 butyraldehyde, mPEG acetyl, mPEG piperidone, mPEG methylketone, mPEG "linkerless" maleimide, mPEG vinyl sulfone, mPEG thiol, mPEG orthopyridylthioester, mPEG orthopyridyl disulfide, Fmoc-PEG-NHS, Boc-PEG-NHS, vinylsulfone PEG-NHS, acrylate PEG-NHS, fluorescein PEG-NHS, and biotin PEG-NHS (see, e.g., Monfardini et al., *Bioconjugate Chem.* 6:62-69, 1995; Veronese et al., *J. Bioactive Compatible Polymers* 12:197-207, 1997; U.S. Pat. Nos. 5,672,662; 5,932,462; 6,495,659; 6,737,505; 4,002,531; 4,179,337; 5,122,614; 5,183,550; 5,324,844; 5,446,090; 5,612,460; 5,643,575; 5,766,581; 5,795,569; 5,808,096; 5,900,461; 5,919,455; 5,985,263; 5,990,237; 6,113,906; 6,214,966; 6,258,351; 6,340,742; 6,413,507; 6,420,339; 6,437,025; 6,448,369; 6,461,802; 6,828,401; 6,858, 736; U.S. 2001/0021763; U.S. 2001/0044526; U.S. 2001/ 0046481; U.S. 2002/0052430; U.S. 2002/0072573; U.S. 2002/0156047; U.S. 2003/0114647; U.S. 2003/0143596; U.S. 2003/0158333; U.S. 2003/0220447; U.S. 2004/ 0013637; US 2004/0235734; U.S. 2005/000360; U.S. 2005/ 0114037; U.S. 2005/0171328; U.S. 2005/0209416; EP 01064951; EP 0822199; WO 00176640; WO 0002017; WO 0249673; WO 9428024; and WO 0187925).

d. Protein Transduction Domain

The modified u-PA polypeptides provided herein can be linked, such as a fusion protein containing an antibody, or antigen binding fragment thereof, conjugated to a protein transduction domain (PTD) that increases the retention of the antibody at a target site for therapy, such as a mucosal site, such as the eye. Any PTD can be employed so long as the PTD promotes the binding to target cell surfaces at the therapeutic site (e.g. mucosal site) and/or uptake of the modified u-PA polypeptide by target cells at the therapeutic site (e.g. mucosal site, such as the eye).

Generally, PTDs include short cationic peptides that can bind to the cell surface through electrostatic attachment to the cell membrane and can be uptaken by the cell by membrane translocation (Kabouridis (2003) *TRENDS Biotech* 21(11) 498-503). The PTDs provided generally interact with a target cell via binding to glycosaminoglycans (GAGs), such as for example, hyaluronic acid, heparin, heparan sulfate, dermatan sulfate, keratin sulfate or chondroitin sulfate and their derivatives.

The protein transduction domain can be of any length. Generally the length of the PTD ranges from 5 or about 5 to 100 or about 100 amino acids in length. For example, the length of the PTD can range from 5 or about 5 to 25 or about 25 amino acids in length. In some examples, the PTD is 5, 6, 7, 8, 9, 10, 11, 12, 13, 14, 15, 16, 17, 18, 19, 20, 21, 22, 23, 24 or 25 amino acids in length.

A single PTD or a plurality thereof can be conjugated to a modified u-PA polypeptide. These are advantageously employed for treatment of ocular or ophthalmic disorders, such as diabetic retinopathies or macular degeneration, including AMD. For example, multiple copies of the same PTD (e.g., dimer, trimer, tetramer, pentamer, hexamer, heptamer, octamer, nonamer, decamer or larger multimer) or different PTDs can be conjugated to the modified u-PA polypeptide.

Several proteins and their peptide derivatives possess cell internalization properties. Exemplary PTDs are known in the art and include, but are not limited to, PTDs listed in the Table below, including, for example, PTDs derived from human immunodeficiency virus 1 (HIV-1) TAT (SEQ ID NOS:125-135; Ruben et al. (1989) *J. Virol.* 63:1-8), the herpes virus tegument protein VP22 (SEQ ID NO: 140; Elliott and O'Hare (1997) *Cell* 88:223-233), the homeotic protein of *Drosophila melanogaster* Antennapedia (Antp) protein (Penetratin PTD; SEQ ID NO: 112; Derossi et al. (1996) *J. Biol. Chem.* 271:18188-18193), the protegrin 1 (PG-1) anti-microbial peptide SynB (e.g., SynB1 (SEQ ID NO: 121), SynB3 (SEQ ID NO: 122), and SynB4 (SEQ ID NO: 123); Kokryakov et al. (1993) *FEBS Lett.* 327:231-236) and the Kaposi fibroblast growth factor (SEQ ID NO: 105; Lin et al., (1995) *J. Biol. Chem.* 270-14255-14258).

Other proteins and their peptide derivatives have been found to possess similar cell internalization properties. The carrier peptides that have been derived from these proteins show little sequence homology with each other, but are all highly cationic and arginine or lysine rich. Indeed, synthetic poly-arginine peptides have been shown to be internalized with a high level of efficiency and can be selected for conjugation to an antibody provided (Futaki et al. (2003) *J. Mol. Recognit.* 16:260-264; Futaki et al. (2001) *J. Biol. Chem.* 276:5836-5840). The PTD also can be selected from among one or more synthetic PTDs, including but not limited to, transportan (SEQ ID NO: 136; Pooga et al. (1998) *FASEB J.* 12:67-77; Pooga et al. (2001) *FASEB J.* 15:1451-1453), MAP (SEQ ID NO: 103; Oehlke et al. (1998) *Biochim. Biophys. Acta.* 1414:127-139), KALA (SEQ ID NO: 101; Wyman et al. (1997) *Biochemistry* 36:3008-3017) and other cationic peptides, such as, for example, various β-cationic peptides (Akkarawongsa et al. (2008) *Antimicrob. Agents and Chemother.* 52(6):2120-2129). Additional PTD peptides and variant PTDs also are provided in, for example, U.S. Patent Publication Nos. US 2005/0260756, US 2006/ 0178297, US 2006/0100134, US 2006/0222657, US 2007/ 0161595, US 2007/0129305, European Patent Publication No. EP 1867661, PCT Publication Nos. WO 2000/062067, WO 2003/035892, WO 2007/097561, WO 2007/053512 and Table 13 herein (below). Any such PTDs provided herein or known in the art can be conjugated to a provided therapeutic antibody.

TABLE 13

Known Protein Transduction Domains

| Protein Transduction Domain (PTD) | Source Protein | SEQ ID NO |
|---|---|---|
| TRSSRAGLQFPVGRVHRLLRK | Buforin II | 82 |
| RKKRRRESRKKRRRES | DPV3 | 83 |
| GRPRESGKKRKRKRLKP | DPV6 | 84 |
| GKRKKKGKLGKKRDP | DPV7 | 85 |
| GKRKKKGKLGKKRPRSR | DPV7b | 86 |
| RKKRRRESRRARRSPRHL | DPV3/10 | 87 |
| SRRARRSPRESGKKRKRKR | DPV10/6 | 88 |
| VKRGLKLRHVRPRVTRMDV | DPV1047 | 89 |
| VKRGLKLRHVRPRVTRDV | DPV1048 | 90 |
| SRRARRSPRHLGSG | DPV10 | 91 |
| LRRERQSRLRRERQSR | DPV15 | 92 |
| GAYDLRRRERQSRLRRRERQSR | DPV15b | 93 |
| WEAALAEALAEALAEHLAEAL AEALEALAA | GALA | 94 |
| KGSWYSMRKMSMKIRPFFPQQ | Fibrinogen beta chain | 95 |
| KTRYYSMKKTTMKIIPFNRL | Fibrinogen gamma chain precursor | 96 |
| RGADYSLRAVRMKIRPLVTQ | Fibrinogen alpha chain | 97 |
| LGTYTQDFNKFHTFPQTAIGV GAP | hCT(9-32) | 98 |
| TSPLNIHNGQKL | HN-1 | 99 |
| NSAAFEDLRVLS | Influenza virus nucleoprotein (NLS) | 100 |
| WEAKLAKALAKALAKHLAKAL AKALKACEA | KALA | 101 |

TABLE 13-continued

Known Protein Transduction Domains

| Protein Transduction Domain (PTD) | Source Protein | SEQ ID NO |
|---|---|---|
| VPMLKPMLKE | Ku70 | 102 |
| KLALKLALKALKAALKLA | MAP | 103 |
| GALFLGFLGAAGSTMGAWSQPKKKRKV | MPG | 104 |
| AAVALLPAVLLALLAP | Human Fibroblast growth factor 4 (Kaposi Fibroblast growth factor) | 105 |
| VQRKRQKLM | N50 (NLS of NF-kB P50) | 106 |
| KETWWETWWTEWSQPKKKRKV | Pep-1 | 107 |
| SDLWEMMMVSLACQY | Pep-7 | 108 |
| RQIKIWFQNRRMKWKK | Penetratin | 109 |
| GRQIKIWFQNRRMKWKK | Penetratin variant | 110 |
| RRMKWKK | Short Penetratin | 111 |
| ERQIKIWFQNRRMKWKK | Penetratin 42-58 | 112 |
| RRRRRRR | Poly Arginine-R7 | 113 |
| RRRRRRRRR | Poly Arginine-R9 | 114 |
| RVIRVWFQNKRCKDKK | pISL | 115 |
| MANLGYWLLALFVTMWTDVGLCKKRPKP | Prion mouse PrPc1-28 | 116 |
| LLIILRRRIRKQAHAHSK | pVEC | 117 |
| LLIILRRRIRKQAHAH | pVEC variant | 118 |
| VRLPPPVRLPPPVRLPPP | SAP | 119 |
| PKKKRKV | SV-40 (NLS) | 120 |
| RGGRLSYSRRRFSTSTGR | SynB1 | 121 |
| RRLSYSRRRF | SynB3 | 122 |
| AWSFRVSYRGISYRRSR | SynB4 | 123 |
| YGRKKRRQRRRPPQ | Tat 47-60 | 124 |
| YGRKKRRQRRR | Tat 47-57 | 125 |
| YGRKKRRQRR | Tat 47-56 | 126 |
| GRKKRRQRR | Tat 48-56 | 127 |
| GRKKRRQRRR | Tat 48-57 | 128 |
| RKKRRQRRR | Tat 49-57 | 129 |
| RKKRRQRR | Tat 49-56 | 130 |
| GRKKRRQRRRPPQ | Tat 48-60 | 131 |
| GRKKR | Tat 48-52 | 132 |
| CFITKALGISYGRKKRRQRRRPPQFSQTHQVSLSKQ | Tat 37-72 | 133 |
| FITKALGISYGRKKRRQRRRPPQFSQTHQVSLSKQ | Tat 38-72 | 134 |
| YGRKKRRQRRRPP | Tat 47-59 | 135 |
| GWTLNSAGYLLGKINLKALAALAKKIL | Transportan | 136 |
| AGYLLGKINLKALAALAKKIL | Transportan 10 | 137 |
| GWTLNSAGYLLG | Transportan derivative | 138 |
| INLKALAALAKKIL | Transportan derivative | 139 |
| DAATATRGRSAASRPTERPRAPARSASRPRRPVD | VP22 | 140 |
| DPKGDPKGVTVTVTVTVTGKGDPKPD | VT5 | 141 |
| GALFLGWLGAAGSTMGAWSQPKKKRKV | Signal Sequence-based peptide | 142 |
| KLALKLALKALKAALKLA | Amphiphilic model peptide | 143 |
| KFFKFFKFFK | Bacterial cell wall permeating | 144 |
| LLGDFFRKSKEKIGKEFKRIVQRIKDFLRNLVPRTES | LL-37 | 145 |
| SWLSKTAKKLENSAKKRISEGIAIAIQGGPR | Cecropin P1 | 146 |
| ACYCRIPACIAGERRYGTCIYQGRLWAFCC | alpha defensin | 147 |
| DHYNCVSSGGQCLYSACPIFKIQGTCYRGKAKCCK | beta defensin | 148 |
| RKCRIWIRVCR | Bactenecin | 149 |
| RRRPRPPYLPRPRPPPFFPPRLPPRIPPGFPPRFPPRFPGKR | PR-39 | 150 |
| ILPWKWPWWPWRR | Indolicidin | 151 |
| GALFLGWLGAAGSTMGAWSQPKKKRKV | MPS | 152 |
| PVIRRVWFQNKRCKDKK | pIs1 | 153 |

In some examples, the PTDs can be modified by replacement of a lysine or arginine with another basic amino acid, such as replacement of a lysine with an arginine or by replacement of an arginine with a lysine.

E. ASSAYS TO ASSESS OR MONITOR U-PA ACTIVITY ON COMPLEMENT-MEDIATED FUNCTIONS

The modified u-PA polypeptides provided herein exhibit altered specificity and/or selectivity for complement protein C3. Exemplary modified u-PA polypeptides specifically cleave complement protein C3 and thereby alter complement activation. Further, exemplary modified u-PA polypeptides provided herein have altered, or reduced, specificity and/or selectivity for cleavage of natural substrates of u-PA, such as plasminogen, and binding to uPAR.

Various in vitro and in vivo assays can be used to monitor or screen u-PA polypeptides for their ability to cleave complement protein C3 and for their effects on complement activation and complement-mediated diseases and disorders. Such assays are well known to those of skill in the art. One of skill in the art can test a particular u-PA polypeptide for cleavage of complement protein C3 and/or test to assess any change in the effects of a u-PA on a complement-mediated activity compared to the absence of a protease. Some such assays are exemplified herein.

Exemplary in vitro and in vivo assays are provided herein for comparison of an activity of a modified u-PA polypeptide on the function of complement protein C3. As discussed below, numerous assays, such as assays for measuring complement activation, are known to one of skill in the art. Also provided herein are exemplary assays for determining the activity of the modified u-PA polypeptides for wild type u-PA activities, such as cleavage of plasminogen or binding to uPAR. Also provided are assays for determining the specificity of the modified u-PA polypeptides for complement protein C3. Exemplary assays are described below.

1. Methods for Assessing Effects of u-PA on Complement Protein C3 Activity

A modified u-PA protease can exhibit alterations in specificity and/or selectivity to any one or more complement proteins and thereby inactivate any one or more complement proteins, such as, for example, C3, compared to the corresponding full-length, scaffold or wild-type form of the modified u-PA protease. Modified u-PA proteases retain their protease activity, but can exhibit an increased specificity and/or selectivity to any one or more complement proteins. Exemplary modified u-PA proteases specifically cleave any one or more complement protein, such as, for example, C3, and thereby alter the activity of a complement protein. All such modified u-PA proteases with increased specificity and/or selectivity to any one or more complement protein are candidate therapeutics.

Where the modified u-PA protease exhibits an increased specificity and/or selectivity to any one or more complement protein, in vitro and in vivo assays can be used to monitor or screen proteases for effects on complement-mediated functions. Such assays are well known to those of skill in the art. One of skill in the art can test a modified u-PA protease for cleavage of any one or more complement protein, such as, for example, C3, and/or test to assess any change in the effects of a modified u-PA protease on a complement-mediated activity compared to the absence of a modified u-PA protease. Some such assays are exemplified herein.

Exemplary in vitro and in vivo assays are provided herein for comparison of an activity of a modified u-PA protease on the function of any one or more targeted complement proteins. Many of the assays are applicable to other proteases and modified proteases. As discussed above, assays for activities of complement include, but are not limited to, assays that measure activation products of complement activation, such as for example the C5b-9 MAC complex, and generation of any one or more of the complement cleavage products such as C4a, C5a, C3b, and C3d. Assays to measure complement activation also include functional assays that measure the functional activity of specific components of the complement pathways, such as for example hemolytic assays used to measure activation of any one of the classical, lectin or alternative pathways. Assays to assess effects of proteases and modified proteases on complement proteins and/or complement-mediated functions include, but are not limited to, SDS-analysis followed by Western Blot or Coomassie Brilliant Blue staining, enzyme immunoassays, and hemolytic assays. In one example, in vitro assays can be performed using purified complement proteins. In another example, in vivo assays can be performed by testing the serum of a species, including mammalian or human species, for functional activation of complement. Exemplary assays are described below.

In one example, in vitro assays can be performed using purified complement protein C3, as exemplified in Example 2-4. In another example, in vitro assays can be conducted in physiologically relevant solutions (i.e., vitreous humor), as exemplified in Example 5. In another example, in vitro assays can be performed using peptide libraries to assess cleavage specificity. In another example, assays can be conducted to assess the normal functions of the modified u-PA polypeptides, i.e., activity towards normal substrates. Various disease models known to one of skill in the art can be used to test the efficacy of u-PA polypeptides provided herein on various complement-mediated diseases and disorders.

a. Protein Detection

Protein detection is a means to measure individual complement components in a sample. Complement proteins can be detected to assess directly the effects of a u-PA polypeptide on cleavage of complement protein C3, or alternatively, complement proteins can be measured as a means to assess complement activation. Complement protein C3, treated in the presence or absence of a u-PA polypeptide, can be analyzed by any one or more assays including SDS-PAGE followed by Coomassie staining or Western Blot, enzyme immunoassay, immunohistochemistry, flow cytometry, nephelometry, agar gel diffusion, or radial immunodiffusion. Exemplary assays for protein detection are described below.

i. SDS-PAGE Analysis

Analysis of complement proteins in the presence or absence of increasing concentrations of a u-PA polypeptide can be performed by analysis of proteins on SDS-PAGE followed by detection of those proteins. In such examples, complement proteins can be detected by staining for total protein, such as by Coomassie Brilliant Blue stain, Silver stain, or by any other method known to one of skill in the art, or by Western Blot using polyclonal or monoclonal antibodies specific for a specified protein. Typically, a purified complement protein, such as, for example, complement protein C3, can be incubated in the presence or absence of a u-PA polypeptide. The treated complement protein can be resolved on an SDS-PAGE gel followed by a method to detect protein in the gel, for example, by staining with Coomasie Brilliant blue. The treated protein can be compared to its cognate full length protein and the degradation products formed by protease cleavage of the protein can be determined.

In another embodiment, a sample, such as for example human serum or plasma, can be treated in the presence or absence of a u-PA polypeptide or can be collected after treatment of an animal or a human with or without a u-PA polypeptide. The u-PA-treated sample can be analyzed on SDS-PAGE and a specific complement protein can be detected, such as for example C3, C5, or Factor B, by Western Blot using monoclonal or polyclonal antibodies against the protein. The cleavage of the complement protein can be compared to a sample that was not treated with a u-PA polypeptide. Additionally, the sample can be stimulated to initiate complement activation such as by incubation with IgG which stimulates activation of the classical pathway or by LPS which stimulates activation of the alternative pathway. The sample can be resolved by SDS-PAGE for detection of any one or more of the native complement proteins to determine the presence or absence of cleavage products of a specified protein compared to a sample of the protein not treated with a u-PA polypeptide. In such examples, cleavage effector molecules of native complement proteins also can be analyzed by Western Blot using monoclonal and polyclonal antibodies to assess the activation of one or more of the complement pathways. Examples of complement effector molecules can include, but are not limited to, C3a, C3d, iC3b, Bb, and C5-b9. For example, decreased expression in a sample of Bb can indicate that a u-PA polypeptide inhibited the activation of the alternative pathway of complement. The cleavage products of the effector molecules also can be determined to assess the effects of increasing concentrations of a u-PA polypeptide on the cleavage of complement effector molecules themselves.

ii. Enzyme Immunoassay

Enzyme immunoassay (EIA; also called enzyme-linked immunosorbent assay; ELISA) is an assay used to measure the presence of a protein in a sample. Typically, measurement of the protein is an indirect measurement of the binding of the protein to an antibody, which itself is chemically labeled with a detectable substrate such as an enzyme or fluorescent compound. EIA assays can be used to measure the effects of u-PA polypeptides on complement activation by measuring for the presence of a complement effector molecule generated following complement activation. In such examples, a sample, such as for example human serum or plasma, can be pretreated in the presence or absence of increasing concentrations of a u-PA polypeptide and subsequently activated to induce complement activation by incubation with initiating molecules, or can be collected following treatment of an animal or a human with a u-PA polypeptide. For example, the classical pathway can be activated by incubation with IgG and the alternative pathway can be activated by incubation of the sample with LPS. A complement activation assay specific for the lectin pathway requires that the classical pathway of complement is inhibited since the C4/C2 cleaving activity of the lectin pathway is shared with the classical pathway of complement. Inhibition of the classical pathway can be achieved using a high ionic strength buffer which inhibits the binding of C1q to immune complexes and disrupts the C1 complex, whereas a high ionic strength buffer does not affect the carbohydrate binding activity of MBL. Consequently, activation of the lectin pathway can be induced by incubation of a sample, such as human serum or plasma, with a mannan-coated surface in the presence of 1 M NaCl.

Following activation, the sample can be quenched with the addition of Pefabloc (Roche) and EDTA to minimize continued activation of the pathways. Samples can be analyzed for the presence of complement effector molecules by an EIA or ELISA assay. EIA and ELISA assays for measuring complement proteins are well known to one skilled in the art. Any complement activation product can be assessed. Exemplary complement activation products for measurement of complement activation include iC3b, Bb, C5b-9, C3a, C3a-desArg and C5a-desArg. The complement pathway activated can be determined depending on the complement activation product measured. For example, measurement of Bb cleavage product is a unique marker of the alternative pathway.

In some examples, the EIA can be paired with detection of the cleaved complement proteins by analysis of the protease-treated, complement-stimulated sample by SDS-PAGE followed by Western blot analysis for identification of specific complement components. Using densitometry software, the cleavage of the complement product can be compared to the full length complement component cleaved throughout the assay and the appearance of all major degradation products and the percent cleavage can be determined.

iii. Radial Immunodiffusion (RID)

Radial immunodiffusion (RID) is a technique that relies on the precipitation of immune complexes formed between antibodies incorporated into agarose gels when it is poured, and antigen present in a test sample resulting in a circular precipitin line around the sample well. The diameter of the precipitin ring is proportional to the concentration of the antibody (or antigen) present in the test sample. By comparing the diameter of the test specimen precipitin ring to known standards, a relatively insensitive estimation of the concentration of specific antibody or antigen can be achieved. RID can be used to measure the amount of a complement protein in a sample. For example, a sample such as, for example, human serum or plasma, can be treated in the presence or absence of increasing concentrations of a u-PA polypeptide. The protease-treated sample can be added to a well of an agarose gel that has been made to incorporate a polyclonal or monoclonal antibody against any one of the complement proteins such as including, but not limited to, C3, C5, C6, C7, C9, or Factor B. After removal of unprecipitated proteins by exposure to 0.15 M NaCl, the precipitated protein rings can be assessed by staining with a protein dye, such as for example Coomassie Brilliant blue or Crowles double stain.

b. Hemolytic Assays

Functional hemolytic assays provide information on complement function as a whole. This type of assay uses antibody-sensitized or unsensitized sheep erythrocytes. Hemolytic assays include the total hemolytic complement assay (CH50), which measures the ability of the classical pathway and the MAC to lyse a sheep RBC. It depends on the sequential activation of the classical pathway components (C1 through C9) to lyse sheep erythrocytes that have been sensitized with optimal amounts of rabbit anti-sheep erythrocyte antibodies to make cellular antigen-antibody complexes. Hemolytic assays also can include an alternative pathway CH50 assay (rabbit CH50 or APCH50), which measures the ability of the alternative pathway and the MAC to lyse a rabbit RBC. One CH50 and/or APCH50 unit is defined as the quantity or dilution of serum required to lyse 50% of the red cells in the test. Typically, to assess complement activation, a sample, such as, for example, human serum or human plasma, can be treated in the presence or absence of increasing concentrations of a u-PA polypeptide, or can be collected following treatment of an animal or human in the presence or absence of a u-PA polypeptide. The protease-treated sample can be subsequently mixed with sheep's red blood cells that have been activated or sensitized with IgG. A water only sample mixed with sheep red blood cells can act as a total lysis control in order to accurately assess percent lysis of the samples analyzed. The addition of 0.15M NaCl to the sample can be added to stop the lysing reaction. Lysis of the red blood cells, induced by the activation of the terminal components of the complement pathway, can be assessed by measuring the release of hemoglobin. Measurement can be by optical density (OD) readings of the samples using a spectrophotometer at an OD of 415 nm.

In one embodiment, limiting dilution hemolytic assays can be used to measure functional activity of specific components of either pathway. In such an assay, a serum source is used that has an excess of all complement components, but is deficient for the one being measured in the sample, i.e. a media or serum source is complement-depleted for a specific protein. The extent of hemolysis is therefore dependent on the presence of the measured component in the test sample. In such an assay, a purified complement protein, such as for example any one of the native complement proteins including, but not limited to C3, can be incubated in the presence or absence of increasing concentrations of a u-PA polypeptide. The protease-treated purified complement protein can then be mixed with complement-depleted media or plasma and IgG-activated sheep red blood cells and hemolysis of the sample can be assessed as described above. In another embodiment, protease cleavage can be correlated with complement activation by assaying for hemolytic activity of a protease-treated sample, and subsequently analyzing the sample on SDS-PAGE gel followed by staining with a protein stain, such as for example Coomassie Blue. The purified complement protein treated with the proteases can be assessed for cleavage and the percentage of the full length complement component cleaved throughout the assay and the appearance of all major degradation products can be calculated. Alternatively, analysis of the protease-treated complement protein can be by Western blot.

An alternative to the hemolytic assay, called the liposome immunoassay (LIA), can be used to assess activation of the classical pathway. The LIA (Waco Chemicals USA, Richmond, Va.) utilizes dinitrophenyl (DNP)-coated liposomes that contain the enzyme glucose-6-phosphate dehydrogenase. When serum is mixed with the liposomes and a substrate containing anti-DNP antibody, glucose-6-phosphate, and nicotinamide adenine dinucleotide, activated liposomes lyse, and an enzymatic colorimetric reaction occurs which is proportional to total classical complement activity.

c. Methods for Determining Cleavage Sites

Cleavage sequences in complement protein C3 can be identified by any method known in the art (see e.g., published U.S. Publication No. US 2004/0146938). In one example, a cleavage sequence is determined by incubating complement protein C3 with any modified u-PA polypeptide provided herein. Following incubation with the u-PA polypeptide, the C3 protein can be separated by SDS-PAGE and degradative products can be identified by staining with a protein dye such as Coomassie Brilliant Blue. Proteolytic fragments can be sequenced to determine the identity of the cleavage sequences. After identification, fluorogenic peptide substrates designed based on the cleavage sequence of a desired target substrate can be used to assess activity, as described below.

2. Methods for Assessing Wild Type u-PA Activity

The modified u-PA polypeptides provided herein have altered, or reduced, specificity for plasminogen and uPAR. u-PA polypeptides can be tested to determine whether they retain catalytic efficiency and/or substrate specificity for their native substrate plasminogen. For example, cleavage of plasminogen can be assessed by incubation of a u-PA polypeptide with plasminogen and detecting protein cleavage products. In another example, cleavage of plasminogen can be determined in vitro by measuring cleavage of a fluorogenically tagged tetrapeptide of the peptide substrate, for example, a fluorogenic substrate, such as fluorophores ACC (7-amino-4-carbamoylmethylcoumarin) or AMC (7-amino-4-methylcoumarin) linked to a tetrapeptide substrate. In some examples, plasminogen activation assays are used to determine the specificity of the u-PA polypeptides provided herein. In other examples, the ability of the u-PA polypeptides provided herein to bind to the u-PA receptor (uPAR) is determined.

a. Cleavage of Plasminogen

In one example, modified u-PA polypeptides can be assayed using individual fluorogenic peptide substrates corresponding to the desired cleavage sequence. For example, a method of assaying for a modified u-PA protease that can cleave any one or more of the desired cleavage sequences includes: (a) contacting a peptide fluorogenic sample (containing a desired target cleavage sequence) with a protease, in such a manner whereby a fluorogenic moiety is released from a peptide substrate sequence upon action of the protease, thereby producing a fluorescent moiety; and (b) observing whether the sample undergoes a detectable change in fluorescence, the detectable change being an indication of the presence of the enzymatically active protease in the sample. In such an example, the desired cleavage sequence is made into a fluorogenic peptide by methods known in the art. In one embodiment, the individual peptide cleavage sequences can be attached to a fluorogenically tagged substrate, such as for example an ACC or AMC fluorogenic leaving group, and the release of the fluorogenic moiety can be determined as a measure of specificity of a protease for a peptide cleavage sequence. The rate of increase in fluorescence of the target cleavage sequence can be measured such as by using a fluorescence spectrophotometer. The rate of increase in fluorescence can be measured over time. Michaelis-Menton kinetic constants can be determined by the standard kinetic methods. The kinetic constants $k_{cat}$, $K_m$ and $k_{cat}/K_m$ can be calculated by graphing the inverse of the substrate concentration versus the inverse of the velocity of substrate cleavage, and fitting to the Lineweaver-Burk equation ($1/\text{velocity}=(K_m/V_{max})(1/[S])+1/V_{max}$; where $V_{max}=[ET]k_{cat}$). The second order rate constant or specificity constant ($k_{cat}/K_m$) is a measure of how well a substrate is cut by a particular protease. For example, an ACC- or AMC-tetrapeptide such as Ac-CPGR-AMC can be made and incubated with a modified u-PA polypeptide provided herein and activity of the u-PA polypeptide can be assessed by assaying for release of the fluorogenic moiety. The choice of the tetrapeptide depends on the desired cleavage sequence to target and can be empirically determined.

In other embodiments, u-PA polypeptides also can be assayed to ascertain that, when in an active form, they cleave the desired sequence when presented in the context of the full-length protein. In one example, a purified target protein, i.e. plasminogen, can be incubated in the presence or absence of a selected u-PA polypeptide and the cleavage event can be monitored by SDS-PAGE followed by Coomassie Brilliant Blue staining for protein and analysis of cleavage products using densitometry.

b. Plasminogen Activation Assays

Any assay known to one of skill in the art can be used to determine if the u-PA polypeptides activate plasminogen. In one example, activation of plasminogen can be determined by incubating the polypeptides in the presence of plasminogen and a detectable plasmin substrate, such as, for example, the chromogenic substrate H-D-Val-Leu-Lys-p-nitroanalide (Chromogenix S-2251) or the fluorogenic substrate H-D-Val-Leu-Lys-7-amido-4-methylcoumarin. Hydrolysis is then monitored by measuring absorbance at 405 nm or by detecting fluorescence using a fluorescence plate reader with an excitation wavelength of 390 nm and an emission wavelength of 480 nm. In another example, activation of plasminogen is assessed while the u-PA polypeptides are bound to uPAR. In such example, the u-PA polypeptides are first bound to uPAR on a cell surface, such as a U397 cell, followed by addition of plasminogen and a detectible plasmin substrate and hydrolysis is measured as described above.

c. u-PA-uPAR Binding Assays

Binding of the u-PA polypeptides to uPAR can be assessed by any assay known to one of skill in the art to detect protein-protein binding interactions, including, but not limited to, solid phase binding assays, ELISA, surface plasmon resonance and FACS. In one example, ELISA can be used. The recombinant uPAR is immobilized on a microtiter plate and u-PA polypeptide binding is assessed by addition of a reagent that specifically binds to u-PA, such as, for example, a u-PA binding antibody. In another example, binding can be determined in a cell based assay using a cell line, such as, for example, U397 cells, that expresses the u-PA receptor. The u-PA polypeptides can be labeled, for example, with a chromogenic, fluorogenic or radioactive substrate to effect detection of binding.

d. C3 Cleavage

The activity of the modified uPA polypeptides can be assessed by cleavage of the substrate complement protein human C3 by measuring the amount of intact human C3 remaining after incubation with various concentrations of the modified uPA protease. In accord with this assay, signal is generated in the presence of intact human C3, and is lost as the C3 is cleaved. In other examples, C3 activation assays are used to determine the specificity of the modified uPA polypeptides provided herein.

Purified C3 protein can be incubated with the modified u-PA polypeptides and the residual levels of undigested human C3 can be quantified by any assay known in the art to assess protein concentration, such as, for example using an Amplified Luminescent Proximity Homogeneous Assay Screen (AlphaScreen®; Perkin Elmer). The C3/uPA polypeptide mixture is incubated with α-mouse IgG-coated acceptor beads, and following incubation the α-hC3 mAb/acceptor beads mixture is incubated with a biotinylated α-hC3 pAb. Streptavidin-coated donor beads are added to the mixture and the 'alphascreen' signal (Excitation=680 nm, Emission=570 nm) is then measured. This signal corresponds to the concentration of remaining C3 protein. The concentration of uPA polypeptide required to cleave through 50% of the available hC3 ($EC_{50}$) can be calculated.

ACC-AGR+ELISA

Provided herein are methods of assessing substrate specificity of the modified u-PA polypeptides. The use of a fluorogenic peptide substrate, such as for example a 7-amino-4-methylcoumarin (AMC) fluorogenic peptide substrate or a 7-amino-4-carbamoylmethylcoumarin (ACC) fluorogenic peptide substrate, can be used to assay the activity of a modified protease whereby a fluorogenic moiety is released from a peptide substrate upon action of the protease, and the release of the fluorogenic moiety can be determined as a measure of specificity of a protease for a peptide cleavage sequence. The rate of increase in fluorescence of a non-target substrate cleavage sequence or target cleavage sequence can be measured such as by using a fluorescence spectrophotometer. The rate of increase in fluorescence can be measured over time. Michaelis-Menton kinetic constants can be determined by the standard kinetic methods. The kinetic constants $k_{cat}$, $K_m$ and $k_{cat}/K_m$ can be calculated by graphing the inverse of the substrate concentration versus the inverse of the velocity of substrate cleavage, and fitting to the Lineweaver-Burk equation ($1/\text{velocity}=(K_m/V_{max})(1/[S])+1/V_{max}$; where $V_{max}=[ET]k_{cat}$). The specificity constant ($k_{cat}/K_m$) is a measure of how well a substrate is cut by a particular protease.

In one example, any one or more of the cleavage sequences of a complement protein can be determined and used as a desired target cleavage sequence. For example, any one or more of the C3 cleavage sequences. In another example, a sequence corresponding to a substrate of the wild-type protease can be used to assay residual protease activity.

In an additional embodiment, a full length complement protein can be used as a target substrate to assay for protease specificity compared to a full length native target substrate of a protease. Further, a full length complement protein can be used to assess the correlation between substrate specificity and cleavage by a protease of a full length target substrate versus a four amino acid P1-P4 substrate cleavage sequence contained within the target substrate. In one example, a full length C3 protein can be used as a desired cleavage target of any one or more or the proteases to assess specificity. In this example, cleavage of C3 by a modified protease can be compared to cleavage of another full-length substrate, or the cleavage can be compared to a fluorogenic tetrapeptide cleavage sequence of C3. The specificity constant of cleavage of a full length protein by a protease can be determined by using gel densitometry to assess changes in densitometry over time of a full-length target substrate band incubated in the presence of a protease.

In an additional embodiment, the activity of a modified u-PA polypeptide can be assessed after prolonged incubation in cynomolgus plasma or vitreous humor. In one example, the residual protease activity is assayed with fluorogenic substrate AGR-ACC (7-amino-4-carbamoylmethyl-coumarin) after incubation in 80% Cynomolgus vitreous humor. For example, the modified u-PA polypeptide of SEQ ID NO:21 exhibits comparable ability to cleave the fluorogenic substrate AGR-ACC after 7 days incubation in vitreous and PBS. In another example, the modified u-PA polypeptide of SEQ ID NO:21 cleaves the fluorogenic substrate AGR-ACC at a similar levels before and after 7 day incubation in vitreous humor.

Assessing Specificity Using Peptide Libraries

Provided herein are methods of assessing substrate specificity of the resulting modified u-PA polypeptides using peptide libraries coupled to fluorogenic peptides. A modified u-PA polypeptide can be verified for P1-P4 substrate specificity at any given sub-site using a peptide library coupled to a fluorogenic substrate (Harris et al., (2000) Proc. Natl. Acad. Sci. U.S.A. 97:7754; US 2004/0175777; US 2004/0146938). Use of a peptide library or peptide libraries allows for the rapid and facile determination of proteolytic substrate. This strategy involves the use of libraries of peptides whereby one position in the library is held constant (i.e., the P1 position), while the remaining positions (i.e., P4-P2 and/or P1' and/or P2') are composed of all combinations of amino acids used to prepare the library. The use of a combinatorial fluorogenic peptide substrate library, such as for example a 7-amino-4-methylcoumarin (AMC) fluorogenic peptide substrate or a 7-amino-4-carbamoylmethyl-coumarin (ACC) fluorogenic peptide substrate, can be used to assay for the activity of a modified protease whereby a fluorogenic moiety is released from a peptide substrate upon action of the protease. Those of skill in the art will appreciate that these methods provide a wide variety of alternative library formats. In one example, a protease can be profiled with a P1-diverse library. A P1-diverse tetrapeptide library contains ACC- or AMC-fluorogenic tetrapeptides whereby the P1 position is systematically held constant while the P2, P3, and P4 positions contain an equimolar mixture of any one or more of 15 amino acids. Determination and consideration of particular limitations relevant to any particular enzyme or method of substrate sequence specificity determination are within the ability of those of skill in the art.

Those of skill in the art recognize that many methods exist to prepare the peptides. In an exemplary embodiment, the substrate library is screened by attaching a fluorogenically tagged substrate to a solid support. In one example, the fluorogenic leaving group from the substrate peptide is synthesized by condensing an N-Fmoc coumarin derivative, to acid-labile Rink linker to provide ACC resin (Backes et al., (2000) *Nat Biotechnol.* 18:187). Fmoc-removal produces a free amine. Natural, unnatural and modified amino acids can be coupled to the amine, which can be elaborated by the coupling of additional amino acids. In an alternative embodiment, the fluorogenic leaving group can be 7-amino-4-methylcoumarin (AMC) (Harris et al., (2000) *Proc. Natl. Acad. Sci. U.S.A.* 97:7754). After the synthesis of the peptide is complete, the peptide-fluorogenic moiety conjugate can be cleaved from the solid support, or alternatively, the conjugate can remain tethered to the solid support.

Typically, a method of preparing a fluorogenic peptide or a material including a fluorogenic peptide includes: (a) providing a first conjugate containing a fluorogenic moiety covalently bonded to a solid support; (b) contacting the first conjugate with a first protected amino acid moiety and an activating agent, thereby forming a peptide bond between a carboxyl group and the amine nitrogen of the first conjugate; (c) de-protecting, thereby forming a second conjugate having a reactive amine moiety; (d) contacting the second conjugate with a second protected amino acid and an activating agent, thereby forming a peptide bond between a carboxyl group and the reactive amine moiety; and (e) de-protecting, thereby forming a third conjugate having a reactive amine moiety. In an exemplary embodiment, the method further includes: (f) contacting the third conjugate with a third protected amino acid and an activating agent, thereby forming a peptide bond between a carboxyl group and the reactive amine moiety; and (e) de-protecting, thereby forming a fourth conjugate having a reactive amine moiety.

For amino acids that are difficult to couple (e.g., Ile, Val, etc.), free, unreacted amine can remain on the support and complicate subsequent synthesis and assay operations. A specialized capping step employing the 3-nitrotriazole active ester of acetic acid in DMF efficiently acylates the remaining aniline. The resulting acetic-acid capped coumarin that can be present in unpurified substrate sequence solution is generally not a protease substrate sequence.

Solid phase peptide synthesis in which the C-terminal amino acid of the sequence is attached to an insoluble support followed by sequential addition of the remaining amino acids in the sequence is an exemplary method for preparing the peptide backbone of the polypeptides provided herein. Techniques for solid phase synthesis are described by Narany and Merrifield, Solid-Phase Peptide Synthesis; pp. 3-284 in The Peptides: Analysis, Synthesis, Biology. Vol. 2; Special Methods in Peptide Synthesis, Part A., Gross and Meienhofer, eds. Academic press, N.Y., (1980); and Stewart et al., (1984) Solid Phase Peptide Synthesis, 2nd ed. Pierce Chem. Co., Rockford, Ill. Solid phase synthesis is most easily accomplished with commercially available peptide synthesizers utilizing Fmoc or t-BOC chemistry.

For example, peptide synthesis can be performed using well known Fmoc synthesis chemistry. For example, the side chains of Asp, Ser, Thr, and Tyr are protected using t-butyl and the side chain of Cys residue using S-trityl and S-t-butylthio, and Lys residues are protected using t-Boc, Fmoc and 4-methyltrityl. Appropriately protected amino acid reagents are commercially available or can be prepared using art-recognized methods. The use of multiple protecting groups allows selective deblocking and coupling of a fluorophore to any particular desired side chain. Thus, for example, t-Boc deprotection is accomplished using TFA in dichloromethane. Fmoc deprotection is accomplished using, for example, 20% (v/v) piperidine in DMF or N-methylpyrrolidone, and 4-methyltrityl deprotection is accomplished using, for example, 1 to 5% (v/v) TFA in water or 1% TFA and 5% triisopropylsilane in DCM. A t-butylthio deprotection is accomplished using, for example, aqueous mercaptoethanol (10%). Removal of t-butyl, t-boc, and S-trityl groups is accomplished using, for example, TFA:phenol:water:thioanisole:ethanedithiol (85:5:5:2.5:2.5), or TFA:phenol:water (95:5:5).

Diversity at any particular position or combination of positions can be introduced using a mixture of at least two, six, 12, 20 or more amino acids to grow the peptide chain. The mixtures of amino acids can include any useful amount of a particular amino acid in combination with any useful amount of one or more different amino acids. In one embodiment, the mixture is an isokinetic mixture of amino acids (a mixture in appropriate ratios to allow for equal molar reactivity of all components). Modified proteases, such as for example a modified u-PA protease described herein, can be assayed using individual fluorogenic peptide substrates corresponding to a desired cleavage sequence. A method of assaying for a modified protease that can cleave any one or more of the C3 cleavage sequences includes: (a) contacting a peptide fluorogenic sample (containing a C3 cleavage sequence) with a protease, in such a manner whereby a fluorogenic moiety is released from a peptide substrate sequence upon action of the protease, thereby producing a fluorescent moiety; and (b) observing whether the sample undergoes a detectable change in fluorescence, the detectable change being an indication of the presence of the enzymatically active protease in the sample. In such an example an ACC- or AMC-tetrapeptide such as Ac-AGR-AMC can be made and incubated with a modified protease and activity of the protease can be assessed by assaying for release of the fluorogenic moiety.

Assaying for a protease in a solution simply requires adding a quantity of the stock solution of a protease to a fluorogenic protease indicator peptide and measuring the subsequent increase in fluorescence or decrease in excitation band in the absorption spectrum. The solution and the fluorogenic indicator also can be combined and assayed in a "digestion buffer" that optimizes activity of the protease. Buffers suitable for assaying protease activity are well known to those of skill in the art. In general, a buffer is selected with a pH which corresponds to the pH optimum of the particular protease. For example, a buffer particularly suitable for assaying elastase activity contains 50 mM sodium phosphate, 1 mM EDTA at pH 8.9. The measurement is most easily made in a fluorometer, an instrument that provides an "excitation" light source for the fluorophore and then measures the light subsequently emitted at a particular wavelength. Comparison with a control indicator solution lacking the protease provides a measure of the protease activity. The activity level can be precisely quantified by generating a standard curve for the protease/indicator combination in which the rate of change in fluorescence produced by protease solutions of known activity is determined.

While detection of fluorogenic compounds can be accomplished using a fluorometer, detection also can be accomplished by a variety of other methods well known to those of skill in the art. Thus, for example, when the fluorophores emit in the visible wavelengths, detection can be simply by visual inspection of fluorescence in response to excitation by a light source. Detection also can be by means of an image analysis system utilizing a video camera interfaced to a digitizer or other image acquisition system. Detection also can be by visualization through a filter, as under a fluorescence microscope. The microscope can provide a signal that is simply visualized by the operator. Alternatively, the signal can be recorded on photographic film or using a video analysis system. The signal also can simply be quantified in real time using either an image analysis system or a photometer.

Thus, for example, a basic assay for protease activity of a sample involves suspending or dissolving the sample in a buffer (at the pH optima of the particular protease being assayed) or in a test condition (e.g., vitreous humor or serum), adding to the buffer a fluorogenic protease peptide indicator, and monitoring the resulting change in fluorescence using a spectrofluorometer as shown in e.g., Harris et al., (1998) *J Biol Chem* 273:27364. The spectrofluorometer is set to excite the fluorophore at the excitation wavelength of the fluorophore. The fluorogenic protease indicator is a substrate sequence of a protease that changes in fluorescence due to a protease cleaving the indicator.

Modified proteases also are assayed to ascertain that they will cleave the desired sequence when presented in the context of the full-length protein. The target substrate proteins containing C3 cleavage sites are in the C3 activation cleavage or active sites. Methods to assess cleavage of a target protein are described herein and/or are well known in the art. In one example, a purified complement protein, for example C3, can be incubated in the presence or absence of a modified protease and the cleavage event can be monitored by SDS-PAGE followed by Coomassie Brilliant Blue staining for protein and analysis of cleavage products using densitometry. The activity of the target protein also is assayed, such as, for example in a hemolysis assay, using methods described herein or that are well known in the art, to verify that its function has been destroyed by the cleavage event.

3. Specificity

The specificity constant of cleavage of target substrate, e.g., complement protein C3 or plasminogen, by a modified u-PA polypeptide can be determined by using gel densitometry to assess changes in densitometry over time of a full-length target substrate incubated in the presence of a u-PA polypeptide. In specific embodiments, comparison of the specificities of a modified u-PA polypeptide can be used to determine if the modified u-PA polypeptide exhibits altered, for example, increased, specificity for C3 compared to the wild-type u-PA polypeptide. The specificity of a u-PA polypeptide for a target substrate, e.g. complement protein C3, can be determined from the specificity constant of cleavage of a target substrate compared to a non-target substrate (e.g. the native wild-type substrate of u-PA). A ratio of the specificity constants of a modified u-PA polypeptide for the target substrate C3 versus a non-target substrate, such as plasminogen, can be made to determine a ratio of the efficiency of cleavage of the modified u-PA polypeptide. Comparison of the ratio of the efficiency of cleavage between a modified u-PA polypeptide and a wild-type u-PA polypeptide can be used to assess the fold change in specificity for a target substrate. Specificity can be at least 2-fold, at least 4-fold, at least 5-fold, at least 6-fold, at least 7-fold, 8, 9, 10, 20, 30, 40, 50, 60, 70, 80, 90, 100, 200, 300, 400, 500, 600, 700, 800, 900, or 1000 times or more when compared to the specificity of a wild-type u-PA polypeptide for a target substrate versus a non-target substrate.

Kinetic analysis of cleavage of native substrates of a u-PA polypeptide can be compared to analysis of cleavage of desired target substrates in complement protein C3 to assess specificity of the modified u-PA polypeptide for complement protein C3. Second order rate constants of inhibition (ki) can be assessed to monitor the efficiency and reactivity of a modified u-PA polypeptide for complement protein C3. For purposes herein, the modified u-PA polypeptides cleave C3 so that complement activation is inhibited, and, as shown in the Examples, they do so with significantly greater activity, such as at least 5-fold more activity, than the unmodified u-PA polypeptide (or u-PA polypeptide modified with the C122S replacement, which eliminates a free cysteine to thereby reduce aggregation). For example, the modified u-PA polypeptide of SEQ ID NO:21 cleaves human C3 in the assay described herein with a an $EC_{50}$ of 19 nM, compared to 3380 nM for the wild-type protease domain of SEQ ID NO:5.

4. Disease Models

The modified u-PA polypeptides provided herein can be used in any clinically relevant disease model known to one of skill in the art to determine their effects on complement-mediated diseases or disorders. Exemplary assays include, but are not limited to, assays for transplantation, including in vitro assays with human islet cells (Tjernberg et al. (2008) *Transplantation* 85:1193-1199) and ex vivo assays with pig kidneys (Fiane et al. (1999) *Xenotransplantation* 6:52-65); bioincompatibility, including in vitro artificial surface-induced inflammation (Lappegard et al. (2008) *J Biomed Mater Res A* 87:129-135; Lappegard et al. (2005) *Ann Thorac Surg* 79:917-923; Nilsson et al. (1998) *Blood* 92:1661-1667; Schmidt et al. (2003) *J Biomed Mater Res A* 66:491-499); inflammation, including in vitro *E. coli*-induced inflammation (Mollnes et al. (2002) *Blood* 100:1867-1877) and heparin/protamine complex-induced inflammation in baboons (Soulika et al. (2000) *Clin Immunol* 96:212-221); age-related macular degeneration in rabbits and monkeys and rodents (Chi et al. (2010) *Adv Exp Med Biol* 703:127-135; Pennesi et al. (2012) *Mol. Aspects Med.* 33(4): 487-509; Fletcher et al. (2014) *Optm. Vis. Sci.* 91(8):878-886; Forest et al., (2015) *Disease Models and Mechanisms* 8:421-427); and delayed graft function in pigs (Hanto et al., (2010) *Am J Transplant* 10(11):2421-2430) and dogs (Petrinec et al., (1996) *Surgery* 61:1331-1337).

F. METHODS OF PRODUCING NUCLEIC ACIDS ENCODING MODIFIED U-PA POLYPEPTIDES THEREOF

Polypeptides of a modified u-PA polypeptide set forth herein can be obtained by methods well known in the art for protein purification and recombinant protein expression. Polypeptides also can be synthesized chemically. Modified or variant, including truncated forms, can be engineered from a wild type polypeptide using standard recombinant DNA methods. For example, modified u-PA polypeptides can be engineered from a wild type polypeptide, such as by site-directed mutagenesis.

1. Isolation or Preparation of Nucleic Acids Encoding u-PA Polypeptides Polypeptides can be cloned or isolated using any available methods known in the art for cloning and isolating nucleic acid molecules. Such methods include PCR amplification of nucleic acids and screening of libraries, including nucleic acid hybridization screening, antibody-based screening and activity-based screening. For example, when the polypeptides are produced by recombinant means, any method known to those of skill in the art for identification of nucleic acids that encode desired genes can be used. Any method available in the art can be used to obtain a full length or partial (i.e., encompassing the entire coding region) cDNA or genomic DNA clone encoding a u-PA, such as from a cell or tissue source.

Methods for amplification of nucleic acids can be used to isolate nucleic acid molecules encoding a desired polypeptide, including for example, polymerase chain reaction (PCR) methods. Exemplary of such methods include use of a Perkin-Elmer Cetus thermal cycler and Taq polymerase (Gene Amp). A nucleic acid containing material can be used as a starting material from which a desired polypeptide-encoding nucleic acid molecule can be isolated. For example, DNA and mRNA preparations, cell extracts, tissue extracts, fluid samples (e.g. blood, serum, saliva), and samples from healthy and/or diseased subjects can be used in amplification methods. The source can be from any eukaryotic species including, but not limited to, vertebrate, mammalian, human, porcine, bovine, feline, avian, equine, canine, and other primate sources. Nucleic acid libraries also can be used as a source of starting material. Primers can be designed to amplify a desired polypeptide. For example, primers can be designed based on expressed sequences from which a desired polypeptide is generated. Primers can be designed based on back-translation of a polypeptide amino acid sequence. If desired, degenerate primers can be used for amplification. Oligonucleotide primers that hybridize to sequences at the 3' and 5' termini of the desired sequence can be used as primers to amplify by PCR sequences from a nucleic acid sample. Primers can be used to amplify the entire full-length u-PA, or a truncated sequence thereof, such as a nucleic acid encoding any of the soluble u-PA polypeptides provided herein. Nucleic acid molecules generated by amplification can be sequenced and confirmed to encode a desired polypeptide.

Additional nucleotide sequences can be joined to a polypeptide-encoding nucleic acid molecule, including linker sequences containing restriction endonuclease sites for the purpose of cloning the synthetic gene into a vector, for example, a protein expression vector or a vector designed for the amplification of the core protein coding DNA sequences. Furthermore, additional nucleotide sequences specifying functional DNA elements can be operatively linked to a polypeptide-encoding nucleic acid molecule. Examples of such sequences include, but are not limited to, promoter sequences designed to facilitate intracellular protein expression, and secretion sequences, for example heterologous signal sequences, designed to facilitate protein secretion. Such sequences are known to those of skill in the art. Additional nucleotide residue sequences such as sequences of bases specifying protein binding regions also can be linked to enzyme-encoding nucleic acid molecules. Such regions include, but are not limited to, sequences of residues that facilitate or encode proteins that facilitate uptake of an enzyme into specific target cells, or otherwise alter pharmacokinetics of a product of a synthetic gene.

Tags and/or other moieties can be added, for example, to aid in detection or affinity purification of the polypeptide. For example, additional nucleotide residue sequences such as sequences of bases specifying an epitope tag or other detectable marker also can be linked to enzyme-encoding nucleic acid molecules. Exemplary of such sequences include nucleic acid sequences encoding a SUMO tag or His tag or Flag Tag.

The identified and isolated nucleic acids then can be inserted into an appropriate cloning vector. A large number of vector-host systems known in the art can be used. Possible vectors include, but are not limited to, plasmids or modified viruses, but the vector system must be compatible with the host cell used. Such vectors include, but are not limited to, bacteriophages such as lambda derivatives, or plasmids such as pCMV4, pBR322 or pUC plasmid derivatives or the Bluescript vector (Stratagene, La Jolla, Calif.). The insertion into a cloning vector can, for example, be accomplished by ligating the DNA fragment into a cloning vector which has complementary cohesive termini. Insertion can be effected using TOPO cloning vectors (Invitrogen, Carlsbad, Calif.).

If the complementary restriction sites used to fragment the DNA are not present in the cloning vector, the ends of the DNA molecules can be enzymatically modified. Alternatively, any site desired can be produced by ligating nucleotide sequences (linkers) onto the DNA termini; these ligated linkers can contain specific chemically synthesized oligonucleotides encoding restriction endonuclease recognition sequences. In an alternative method, the cleaved vector and protein gene can be modified by homopolymeric tailing.

Recombinant molecules can be introduced into host cells via, for example, transformation, transfection, infection, electroporation and sonoporation, so that many copies of the gene sequence are generated. In specific embodiments, transformation of host cells with recombinant DNA molecules that incorporate the isolated protein gene, cDNA, or synthesized DNA sequence enables generation of multiple copies of the gene. Thus, the gene can be obtained in large quantities by growing transformants, isolating the recombinant DNA molecules from the transformants and, when necessary, retrieving the inserted gene from the isolated recombinant DNA.

In addition to recombinant production, modified u-PA polypeptides provided herein, can be produced by direct peptide synthesis using solid-phase techniques (see e.g., Stewart et al. (1969) Solid-Phase Peptide Synthesis, WH Freeman Co., San Francisco; Merrifield J (1963) *J Am Chem Soc.*, 85:2149-2154). In vitro protein synthesis can be performed using manual techniques or by automation. Automated synthesis can be achieved, for example, using Applied Biosystems 431A Peptide Synthesizer (Perkin Elmer, Foster City Calif.) in accordance with the instructions provided by the manufacturer. Various fragments of a polypeptide can be chemically synthesized separately and combined using chemical methods.

Also provided herein, are methods of expression of active or activated or activatable forms of the modified u-PA polypeptides, such as two chain activated forms and dimers. As discussed and described herein, and exemplified in Examples 14-16, the nucleic acid encoding modified u-PA polypeptide fusion proteins can be prepared. The nucleic acids encode the modified u-PA protease domains, linked to nucleic acid encoding other sequences, including, but are limited to, secretion signals, such as, for example, the u-PA signal sequence, an IgG kapp chain signal sequence, and an IL-2 signal sequence, the N-terminal portion of u-PA (to produce full-length u-PA), activation sequences, such as for example, the u-PA activation sequence or a furin sequence, and fusion partners, such as an albumin, to alter a property of the u-PA, such as serum half-life, and/or a sequence, such as a His Tag and/or SUMO to increase expression and/or facilitate isolation. These nucleic acid molecules can be expressed in suitable host cells, well known to those of skill in the art, for production of the modified u-PA and/or fusion protein. Generally the nucleic acids encode a signal sequence or other trafficking sequence for secretion or trafficking to an locus for purification. Including nucleic acid encoding an activation sequence can be used to produce an activated form of the modified u-PA polypeptide.

2. Generation of Mutant or Modified Nucleic Acid and Encoding Polypeptides

The modifications provided herein can be made by standard recombinant DNA techniques such as are routine to one of skill in the art. Any method known in the art to effect mutation of any one or more amino acids in a target protein can be employed. Methods include standard site-directed mutagenesis (using e.g. a kit, such as QuikChange available from Stratagene) of encoding nucleic acid molecules, or by solid phase polypeptide synthesis methods.

3. Vectors and Cells

For recombinant expression of one or more of the desired proteins, such as any modified u-PA polypeptide described herein, the nucleic acid containing all or a portion of the nucleotide sequence encoding the protein can be inserted into an appropriate expression vector, i.e., a vector that contains the necessary elements for the transcription and translation of the inserted protein coding sequence. The necessary transcriptional and translational signals also can be supplied by the native promoter for enzyme genes, and/or their flanking regions.

Also provided are vectors that contain a nucleic acid encoding the enzyme. Cells containing the vectors also are provided. The cells include eukaryotic and prokaryotic cells, and the vectors are any suitable for use therein. Generally, the cell is a cell that is capable of effecting glycosylation of the encoded protein.

Prokaryotic and eukaryotic cells containing the vectors are provided. Such cells include bacterial cells, yeast cells, fungal cells, Archea, plant cells, insect cells and animal cells. The cells are used to produce a protein thereof by growing the above-described cells under conditions whereby the encoded protein is expressed by the cell, and recovering the expressed protein. For purposes herein, for example, the enzyme can be secreted into the medium.

A host cell strain can be chosen for its ability to modulate the expression of the inserted sequences or to process the expressed protein in the desired fashion. Such modifications of the polypeptide include, but are not limited to, acetylation, carboxylation, glycosylation, phosphorylation, lipidation and acylation. Post-translational processing can impact the folding and/or function of the polypeptide. Different host cells, such as, but not limited to, CHO (DG44, DXB11, CHO-K1), HeLa, MCDK, 293 and WI38 have specific cellular machinery and characteristic mechanisms for such post-translational activities and can be chosen to ensure the correct modification and processing of the introduced protein. Generally, the choice of cell is one that is capable of introducing N-linked glycosylation into the expressed polypeptide. Hence, eukaryotic cells containing the vectors are provided. Exemplary of eukaryotic cells are mammalian Chinese Hamster Ovary (CHO) cells. For example, CHO cells deficient in dihydrofolate reductase (e.g. DG44 cells) are used to produce polypeptides provided herein.

Provided are vectors that contain a sequence of nucleotides that encodes the modified u-PA polypeptide, coupled to the native or heterologous signal sequence, as well as multiple copies thereof. The vectors can be selected for expression of the enzyme protein in the cell or such that the enzyme protein is expressed as a secreted protein.

In one embodiment, vectors containing a sequence of nucleotides that encodes a polypeptide that has protease activity and contains all or a portion of the protease domain, or multiple copies thereof, are provided. Also provided are vectors that contain a sequence of nucleotides that encodes the protease domain and additional portions of a protease protein up to and including a full length protease protein, as well as multiple copies thereof. The vectors can be selected for expression of the scaffold or modified protease protein or protease domain thereof in the cell or such that the protease protein is expressed as a secreted protein. When the protease domain is expressed the nucleic acid is linked to nucleic acid encoding a secretion signal, such as the *Saccharomyces cerevisiae* α-mating factor signal sequence or a portion thereof, or the native signal sequence.

A variety of host-vector systems can be used to express the protein coding sequence. These include, but are not limited to, mammalian cell systems infected with virus (e.g. vaccinia virus, adenovirus and other viruses); insect cell systems infected with virus (e.g. baculovirus); microorganisms such as yeast containing yeast vectors; or bacteria transformed with bacteriophage, DNA, plasmid DNA, or cosmid DNA. The expression elements of vectors vary in their strengths and specificities. Depending on the host-vector system used, any one of a number of suitable transcription and translation elements can be used.

Any methods known to those of skill in the art for the insertion of DNA fragments into a vector can be used to construct expression vectors containing a chimeric gene containing appropriate transcriptional/translational control signals and protein coding sequences. These methods can include in vitro recombinant DNA and synthetic techniques and in vivo recombinants (genetic recombination). Expression of nucleic acid sequences encoding protein, or domains, derivatives, fragments or homologs thereof, can be regulated by a second nucleic acid sequence so that the genes or fragments thereof are expressed in a host transformed with the recombinant DNA molecule(s). For example, expression of the proteins can be controlled by any promoter/enhancer known in the art. In a specific embodiment, the promoter is not native to the genes for a desired protein. Promoters which can be used include, but are not limited to, the SV40 early promoter (Bernoist and Chambon, *Nature* 290:304-310 (1981)), the promoter contained in the 3' long terminal repeat of Rous sarcoma virus (Yamamoto et al. *Cell* 22:787-797 (1980)), the herpes thymidine kinase promoter (Wagner et al., *Proc. Natl. Acad. Sci. USA* 78:1441-1445 (1981)), the regulatory sequences of the metallothionein gene (Brinster et al., *Nature* 296:39-42 (1982)); prokaryotic expression vectors such as the β-lactamase promoter (Jay et al., (1981) *Proc. Natl. Acad. Sci. USA* 78:5543) or the tac promoter (DeBoer et al., *Proc. Natl. Acad. Sci. USA* 80:21-25 (1983); see also "Useful Proteins from Recombinant Bacteria": in *Scientific American* 242:79-94 (1980)); plant expression vectors containing the nopaline synthetase promoter (Herrara-Estrella et al., *Nature* 303:209-213 (1984)) or the cauliflower mosaic virus 35S RNA promoter (Garder et al., *Nucleic Acids Res.* 9:2871 (1981)), and the promoter of the photosynthetic enzyme ribulose bisphosphate carboxylase (Herrera-Estrella et al., *Nature* 310:115-120 (1984)); promoter elements from yeast and other fungi such as the Gal4 promoter, the alcohol dehydrogenase promoter, the phosphoglycerol kinase promoter, the alkaline phosphatase promoter, and the following animal transcriptional control regions that exhibit tissue specificity and have been used in transgenic animals: elastase I gene control region which is active in pancreatic acinar cells (Swift et al., Cell 38:639-646 (1984); Ornitz et al., Cold Spring Harbor Symp. Quant. Biol. 50:399-409 (1986); MacDonald, Hepatology 7:425-515 (1987)); insulin gene control region which is active in pancreatic beta cells (Hanahan et al., Nature 315:115-122 (1985)), immunoglobulin gene control region which is active in lymphoid cells (Grosschedl et al., Cell 38:647-658 (1984); Adams et al., Nature 318:533-538 (1985); Alexander et al., Mol. Cell Biol. 7:1436-1444 (1987)), mouse mammary tumor virus control region which is active in testicular, breast, lymphoid and mast cells (Leder et al., Cell 45:485-495 (1986)), albumin gene control region which is active in liver (Pinckert et al., Genes and Devel. 1:268-276 (1987)), alpha-fetoprotein gene control region which is active in liver (Krumlauf et al., Mol. Cell. Biol. 5:1639-1648 (1985); Hammer et al., Science 235:53-58 (1987)), alpha-1 antitrypsin gene control region which is active in liver (Kelsey et al., Genes and Devel. 1:161-171 (1987)), beta globin gene control region which is active in myeloid cells (Magram et al., Nature 315:338-340 (1985); Kollias et al., Cell 46:89-94 (1986)), myelin basic protein gene control region which is active in oligodendrocyte cells of the brain (Readhead et al., Cell 48:703-712 (1987)), myosin light chain-2 gene control region which is active in skeletal muscle (Shani, Nature 314:283-286 (1985)), and gonadotrophic releasing hormone gene control region which is active in gonadotrophs of the hypothalamus (Mason et al., Science 234:1372-1378 (1986)).

In a specific embodiment, a vector is used that contains a promoter operably linked to nucleic acids encoding a desired protein, or a domain, fragment, derivative or homolog thereof, one or more origins of replication, and optionally, one or more selectable markers (e.g., an antibiotic resistance gene). Depending on the expression system, specific initiation signals also are required for efficient translation of a u-PA sequence. These signals include the ATG initiation codon and adjacent sequences. In cases where the initiation codon and upstream sequences of u-PA or catalytically active fragments thereof are inserted into the appropriate expression vector, no additional translational control signals are needed. In cases where only coding sequence, or a portion thereof, is inserted, exogenous transcriptional control signals including the ATG initiation codon must be provided. Furthermore, the initiation codon must be in the correct reading frame to ensure transcription of the entire insert. Exogenous transcriptional elements and initiation codons can be of various origins, natural and synthetic. The efficiency of expression can be enhanced by the inclusion of enhancers appropriate to the cell system in use (Scharf et al. (1994) Results Probl Cell Differ 20:125-62; Bittner et al. (1987) Methods in Enzymol, 153:516-544).

Exemplary plasmid vectors for transformation of E. coli cells, include, for example, the pQE expression vectors (available from Qiagen®, Valencia, Calif.; see also literature published by Qiagen® describing the system). pQE vectors have a phage T5 promoter (recognized by E. coli RNA polymerase) and a double lac operator repression module to provide tightly regulated, high-level expression of recombinant proteins in E. coli, a synthetic ribosomal binding site (RBS II) for efficient translation, a 6×His tag coding sequence, to and T1 transcriptional terminators, ColE1 origin of replication, and a beta-lactamase gene for conferring ampicillin resistance. The pQE vectors enable placement of a 6×His tag at either the N- or C-terminus of the recombinant protein. Such plasmids include pQE 32, pQE 30, and pQE 31 which provide multiple cloning sites for all three reading frames and provide for the expression of N-terminally 6×His-tagged proteins. Other exemplary plasmid vectors for transformation of E. coli cells, include, for example, the pET expression vectors (see, U.S. Pat. No. 4,952,496; available from Novagen®, Madison, Wis.; see, also literature published by Novagen® describing the system). Such plasmids include pET 11a, which contains the T7lac promoter, T7 terminator, the inducible E. coli lac operator, and the lac repressor gene; pET 12a-c, which contains the T7 promoter, T7 terminator, and the E. coli ompT secretion signal; and pET 15b and pET19b (Novagen®, Madison, Wis.), which contain a His-Tag™ leader sequence for use in purification with a His column and a thrombin cleavage site that permits cleavage following purification over the column, the T7-lac promoter region and the T7 terminator.

Typically, vectors can be plasmid, viral, or others known in the art, used for expression of the modified u-PA polypeptide in vivo or in vitro. For example, the modified u-PA polypeptide is expressed in mammalian cells, including, for example, Chinese Hamster Ovary (CHO) cells.

Viral vectors, such as adenovirus, retrovirus or vaccinia virus vectors, can be employed. In some examples, the vector is a defective or attenuated retroviral or other viral vector (see U.S. Pat. No. 4,980,286). For example, a retroviral vector can be used (see Miller et al., Meth. Enzymol. 217: 581-599 (1993)). These retroviral vectors have been modified to delete retroviral sequences that are not necessary for packaging of the viral genome and integration into host cell DNA. In some examples, viruses armed with a nucleic acid encoding a modified u-PA polypeptide can facilitate their replication and spread within a target tissue. The virus also can be a lytic virus or a non-lytic virus where the virus selectively replicates under a tissue specific promoter. As the viruses replicate, the coexpression of the u-PA polypeptide with viral genes will facilitate the spread of the virus in vivo.

4. Expression

Modified u-PA polypeptides can be produced by any method known to those of skill in the art including in vivo and in vitro methods. Desired proteins can be expressed in any organism suitable to produce the required amounts and forms of the proteins, such as for example, needed for administration and treatment. Expression hosts include prokaryotic and eukaryotic organisms such as E. coli, yeast, plants, insect cells, mammalian cells, including human cell lines and transgenic animals. Expression hosts can differ in their protein production levels as well as the types of post-translational modifications that are present on the expressed proteins. The choice of expression host can be made based on these and other factors, such as regulatory and safety considerations, production costs and the need and methods for purification.

Many expression vectors are available and known to those of skill in the art and can be used for expression of proteins. The choice of expression vector will be influenced by the choice of host expression system. In general, expression vectors can include transcriptional promoters and optionally enhancers, translational signals, and transcriptional and translational termination signals. Expression vectors that are used for stable transformation typically have a selectable marker which allows selection and maintenance of the transformed cells. In some cases, an origin of replication can be used to amplify the copy number of the vector.

Modified u-PA polypeptides also can be utilized or expressed as protein fusions. For example, an enzyme fusion can be generated to add additional functionality to an enzyme. Examples of enzyme fusion proteins include, but are not limited to, fusions of a signal sequence, a tag such as for localization, e.g. a $his_6$ tag or a myc tag, or a tag for purification, for example, a GST fusion, and a sequence for directing protein secretion and/or membrane association.

For example, a modified u-PA polypeptide described herein is one that is generated by expression of a nucleic acid molecule encoding the protease domain set forth in any one of SEQ ID NOS: 1-6, 8-44 and 52-75 or a sequence of amino acids that exhibits at least 65%, 70%, 75%, 80%, 84%, 90%, 91%, 92%, 93%, 94%, 95%, 96%, 97%, 98%, or 99% sequence identity to a sequence set forth in any of SEQ ID NOS: 1-6, 8-44 and 52-75.

For long-term, high-yield production of recombinant proteins, stable expression is desired. For example, cell lines that stably express a modified u-PA polypeptide can be transformed using expression vectors that contain viral origins of replication or endogenous expression elements and a selectable marker gene. Following the introduction of the vector, cells can be allowed to grow for 1-2 days in an enriched media before they are switched to selective media. The purpose of the selectable marker is to confer resistance to selection, and its presence allows growth and recovery of cells that successfully express the introduced sequences. Resistant cells of stably transformed cells can be proliferated using tissue culture techniques appropriate to the cell types.

Any number of selection systems can be used to recover transformed cell lines. These include, but are not limited to, the herpes simplex virus thymidine kinase (Wigler et al., (1977) *Cell* 11:223-232) and adenine phosphoribosyltransferase (Lowy I et al. (1980) *Cell,* 22:817-23) genes, which can be employed in TK- or APRT-cells, respectively. Also, antimetabolite, antibiotic or herbicide resistance can be used as the basis for selection. For example, DHFR, which confers resistance to methotrexate (Wigler M et al. (1980) *Proc. Natl. Acad. Sci,* 77:3567-70); npt, which confers resistance to the aminoglycosides neomycin and G-418 (Colbere-Garapin F et al. (1981) *J. Mol. Biol.,* 150:1-14); and als or pat, which confer resistance to chlorsulfuron and phosphinotricin acetyltransferase, respectively, can be used. Additional selectable genes have been described, for example, trpB, which allows cells to utilize indole in place of typtophan, or hisD, which allows cells to utilize histinol in place of histidine (Hartman S C and R C Mulligan (1988) *Proc. Natl. Acad. Sci,* 85:8047-8051). Visible markers, such as but not limited to, anthocyanins, beta glucuronidase and its substrate, GUS, and luciferase and its substrate luciferin, also can be used to identify transformants and also to quantify the amount of transient or stable protein expression attributable to a particular vector system (Rhodes C A et al. (1995) *Methods Mol. Biol.* 55:121-131).

The presence and expression of u-PA polypeptides can be monitored. For example, detection of a functional polypeptide can be determined by testing the conditioned media for hyaluronidase enzyme activity under appropriate conditions. Exemplary assays to assess the solubility and activity of expressed proteins are provided herein.

a. Prokaryotic Cells

Prokaryotes, especially *E. coli*, provide a system for producing large amounts of proteins. Transformation of *E. coli* is a simple and rapid technique well known to those of skill in the art. Expression vectors for *E. coli* can contain inducible promoters; such promoters are useful for inducing high levels of protein expression and for expressing proteins that exhibit some toxicity to the host cells. Examples of inducible promoters include the lac promoter, the trp promoter, the hybrid tac promoter, the T7 and SP6 RNA promoters and the temperature regulated λPL promoter.

Proteins, such as any provided herein, can be expressed in the cytoplasmic environment of *E. coli*. The cytoplasm is a reducing environment and for some molecules, this can result in the formation of insoluble inclusion bodies. Reducing agents such as dithiothreotol and β-mercaptoethanol and denaturants, such as guanidine-HCl and urea can be used to resolubilize the proteins. An alternative approach is the expression of proteins in the periplasmic space of bacteria which provides an oxidizing environment and chaperonin-like and disulfide isomerases and can lead to the production of soluble protein. Typically, a leader sequence is fused to the protein to be expressed which directs the protein to the periplasm. The leader is then removed by signal peptidases inside the periplasm. Examples of periplasmic-targeting leader sequences include the pelB leader from the pectate lyase gene and the leader derived from the alkaline phosphatase gene. In some cases, periplasmic expression allows leakage of the expressed protein into the culture medium. The secretion of proteins allows quick and simple purification from the culture supernatant. Proteins that are not secreted can be obtained from the periplasm by osmotic lysis. Similar to cytoplasmic expression, in some cases proteins can become insoluble and denaturants and reducing agents can be used to facilitate solubilization and refolding. Temperature of induction and growth also can influence expression levels and solubility, typically temperatures between 25° C. and 37° C. are used. Typically, bacteria produce aglycosylated proteins. Thus, if proteins require glycosylation for function, glycosylation can be added in vitro after purification from host cells.

b. Yeast Cells

Yeasts such as *Saccharomyces cerevisae, Schizosaccharomyces pombe, Yarrowia lipolytica, Kluyveromyces lactis* and *Pichia pastoris* are well known yeast expression hosts that can be used for production of proteins, such as any described herein. Yeast can be transformed with episomal replicating vectors or by stable chromosomal integration by homologous recombination. Typically, inducible promoters are used to regulate gene expression. Examples of such promoters include GAL1, GAL7 and GAL5 and metallothionein promoters, such as CUP1, AOX1 or other *Pichia* or other yeast promoter. Expression vectors often include a selectable marker such as LEU2, TRP1, HIS3 and URA3 for selection and maintenance of the transformed DNA. Proteins expressed in yeast are often soluble. Co-expression with chaperonins such as Bip and protein disulfide isomerase can improve expression levels and solubility. Additionally, proteins expressed in yeast can be directed for secretion using secretion signal peptide fusions such as the yeast mating type alpha-factor secretion signal from *Saccharomyces cerevisae* and fusions with yeast cell surface proteins such as the Aga2p mating adhesion receptor or the *Arxula adeninivorans* glucoamylase. A protease cleavage site such as for the Kex-2 protease, can be engineered to remove the fused sequences from the expressed polypeptides as they exit the secretion pathway. Yeast also is capable of glycosylation at Asn-X-Ser/Thr motifs.

c. Insects and Insect Cells

Insect cells, particularly using baculovirus expression, are useful for expressing polypeptides such as u-PA polypeptides. Insect cells express high levels of protein and are capable of most of the post-translational modifications used by higher eukaryotes. Baculovirus have a restrictive host range which improves the safety and reduces regulatory concerns of eukaryotic expression. Typical expression vectors use a promoter for high level expression such as the polyhedrin promoter of baculovirus. Commonly used baculovirus systems include the baculoviruses such as *Autographa californica* nuclear polyhedrosis virus (AcNPV), and the *Bombyx mori* nuclear polyhedrosis virus (BmNPV) and an insect cell line such as Sf9 derived from *Spodoptera frugiperda*, *Pseudaletia unipuncta* (A7S) and *Danaus plexippus* (DpN1). For high-level expression, the nucleotide sequence of the molecule to be expressed is fused immediately downstream of the polyhedrin initiation codon of the virus. Mammalian secretion signals are accurately processed in insect cells and can be used to secrete the expressed protein into the culture medium. The cell lines *Pseudaletia unipuncta* (A7S) and *Danaus plexippus* (DpN1) produce proteins with glycosylation patterns similar to mammalian cell systems. Exemplary insect cells are those that have been altered to reduce immunogenicity, including those with "mammalianized" baculovirus expression vectors and those lacking the enzyme FT3.

An alternative expression system in insect cells is the use of stably transformed cells. Cell lines such as the Schnieder 2 (S2) and Kc cells (*Drosophila melanogaster*) and C7 cells (*Aedes albopictus*) can be used for expression. The *Drosophila* metallothionein promoter can be used to induce high levels of expression in the presence of heavy metal induction with cadmium or copper. Expression vectors are typically maintained by the use of selectable markers such as neomycin and hygromycin.

d. Mammalian Expression

Mammalian expression systems can be used to express proteins including U-PA polypeptides. Expression constructs can be transferred to mammalian cells by viral infection such as adenovirus or by direct DNA transfer such as liposomes, calcium phosphate, DEAE-dextran and by physical means such as electroporation and microinjection. Expression vectors for mammalian cells typically include an mRNA cap site, a TATA box, a translational initiation sequence (Kozak consensus sequence) and polyadenylation elements. IRES elements also can be added to permit bicistronic expression with another gene, such as a selectable marker. Such vectors often include transcriptional promoter-enhancers for high-level expression, for example the SV40 promoter-enhancer, the human cytomegalovirus (CMV) promoter and the long terminal repeat of Rous sarcoma virus (RSV). These promoter-enhancers are active in many cell types. Tissue and cell-type promoters and enhancer regions also can be used for expression. Exemplary promoter/enhancer regions include, but are not limited to, those from genes such as elastase I, insulin, immunoglobulin, mouse mammary tumor virus, albumin, alpha fetoprotein, alpha 1 antitrypsin, beta globin, myelin basic protein, myosin light chain 2, and gonadotropic releasing hormone gene control. Selectable markers can be used to select for and maintain cells with the expression construct. Examples of selectable marker genes include, but are not limited to, hygromycin B phosphotransferase, adenosine deaminase, xanthine-guanine phosphoribosyl transferase, aminoglycoside phosphotransferase, dihydrofolate reductase (DHFR) and thymidine kinase. For example, expression can be performed in the presence of methotrexate to select for only those cells expressing the DHFR gene. Fusion with cell surface signaling molecules such as TCR-ζ and Fc$_\varepsilon$RI-γ can direct expression of the proteins in an active state on the cell surface.

Many cell lines are available for mammalian expression including mouse, rat human, monkey, chicken and hamster cells. Exemplary cell lines include but are not limited to CHO, Balb/3T3, HeLa, MT2, mouse NS0 (nonsecreting) and other myeloma cell lines, hybridoma and heterohybridoma cell lines, lymphocytes, fibroblasts, Sp2/0, COS, NIH3T3, HEK293, 293S, 2B8, and HKB cells. Cell lines also are available adapted to serum-free media which facilitates purification of secreted proteins from the cell culture media. Examples include CHO-S cells (Invitrogen®, Carlsbad, Calif., cat #11619-012) and the serum free EBNA-1 cell line (Pham et al., (2003) *Biotechnol. Bioeng.* 84:332-42.). Cell lines also are available that are adapted to grow in special mediums optimized for maximal expression. For example, DG44 CHO cells are adapted to grow in suspension culture in a chemically defined, animal product-free medium.

e. Plants

Transgenic plant cells and plants can be used to express proteins such as any described herein. Expression constructs are typically transferred to plants using direct DNA transfer such as microprojectile bombardment and PEG-mediated transfer into protoplasts, and with *Agrobacterium*-mediated transformation. Expression vectors can include promoter and enhancer sequences, transcriptional termination elements and translational control elements. Expression vectors and transformation techniques are usually divided between dicot hosts, such as *Arabidopsis* and tobacco, and monocot hosts, such as corn and rice. Examples of plant promoters used for expression include the cauliflower mosaic virus promoter, the nopaline syntase promoter, the ribose bisphosphate carboxylase promoter and the ubiquitin and UBQ3 promoters. Selectable markers such as hygromycin, phosphomannose isomerase and neomycin phosphotransferase are often used to facilitate selection and maintenance of transformed cells. Transformed plant cells can be maintained in culture as cells, aggregates (callus tissue) or regenerated into whole plants. Transgenic plant cells also can include algae engineered to produce hyaluronidase polypeptides. Because plants have different glycosylation patterns than mammalian cells, this can influence the choice of protein produced in these hosts.

5. Purification

Host cells transformed with a nucleic acid sequence encoding a modified u-PA polypeptide can be cultured under conditions suitable for the expression and recovery of the encoded protein from cell culture. The protein produced by a recombinant cell is generally secreted, but may be contained intracellularly depending on the sequence and/or the vector used. As understood by those of skill in the art, expression vectors containing nucleic acid encoding u-PA can be designed with signal sequences that facilitate direct secretion of u-PA through prokaryotic or eukaryotic cell membrane.

Thus, methods for purification of polypeptides from host cells depend on the chosen host cells and expression systems. For secreted molecules, proteins are generally purified from the culture media after removing the cells. For intracellular expression, cells can be lysed and the proteins purified from the extract. When transgenic organisms such as transgenic plants and animals are used for expression, tissues or organs can be used as starting material to make a lysed cell extract. Additionally, transgenic animal production can include the production of polypeptides in milk or eggs, which can be collected, and if necessary, the proteins can be extracted and further purified using standard methods in the art.

Proteins, such as modified u-PA polypeptides, can be purified using standard protein purification techniques known in the art including but not limited to, SDS-PAGE, size fractionation and size exclusion chromatography, ammonium sulfate precipitation and ionic exchange chromatography, such as anion exchange. Affinity purification techniques also can be utilized to improve the efficiency and purity of the preparations. For example, antibodies, receptors and other molecules that bind u-PA proteins can be used in affinity purification.

Expression constructs also can be engineered to add an affinity tag to a protein such as a Small Ubiquitin-like Modifier (SUMO) tag, myc epitope, GST fusion or $His_6$ and affinity purified with SUMO or myc antibody, glutathione resin and Ni-resin, respectively. Such tags can be joined to the nucleotide sequence encoding a u-PA as described elsewhere herein, which can facilitate purification of soluble proteins. For example, a modified u-PA polypeptide can be expressed as a recombinant protein with one or more additional polypeptide domains added to facilitate protein purification. Such purification facilitating domains include, but are not limited to, metal chelating peptides such as histidine-tryptophan modules that allow purification on immobilized metals, protein A domains that allow purification on immobilized immunoglobulin and the domain utilized in the FLAGS extension/affinity purification system (Immunex Corp., Seattle Wash.). The inclusion of a cleavable linker sequence such as Factor XA or enterokinase (Invitrogen®, San Diego, Calif.) between the purification domain and the expressed u-PA polypeptide is useful to facilitate purification. One such expression vector provides for expression of a fusion protein containing a u-PA polypeptide in and an enterokinase cleavage site. The Small Ubiquitin-like Modifier (SUMO) tag facilitates purification on IMIAC (immobilized metal ion affinity chromatography), while the enterokinase cleavage site provides a means for purifying the polypeptide from the fusion protein.

Purity can be assessed by any method known in the art including gel electrophoresis, orthogonal HPLC methods, staining and spectrophotometric techniques. The expressed and purified protein can be analyzed using any assay or method known to one of skill in the art, for example, any described in Section 3. These include assays based on the physical and/or functional properties of the protein, including, but not limited to, analysis by gel electrophoresis, immunoassay and assays of u-PA activity.

6. Additional Modifications

The modified u-PA polypeptides provided herein can be modified to improve or alter pharmacokinetic and pharmacological properties. In particular, the modified u-PA polypeptides can be conjugated to a polymer, such as a PEG moiety or dextran or sialiation to reduce immungeniciaty and/or increase half-life in serum and other body fluids including vitreous humor.

a. PEGylation

Polyethylene glycol (PEG) is used in biomaterials, biotechnology and medicine primarily because PEG is a biocompatible, nontoxic, water-soluble polymer that is typically nonimmunogenic (Zhao and Harris, *ACS Symposium Series* 680: 458-72, 1997). In the area of drug delivery, PEG derivatives have been widely used in covalent attachment (i. e., "PEGylation") to proteins to reduce immunogenicity, proteolysis and kidney clearance to increase serum half-life, and to enhance solubility (Zalipsky, *Adv. Drug Del. Rev.* 16:157-82, 1995). Similarly, PEG has been attached to low molecular weight, relatively hydrophobic drugs to enhance solubility, reduce toxicity and alter biodistribution. Typically, PEGylated drugs are injected as solutions.

A related application is synthesis of crosslinked degradable PEG networks or formulations for use in drug delivery since much of the same chemistry used in design of degradable, soluble drug carriers also can be used in design of degradable gels (Sawhney et al., *Macromolecules* 26: 581-87, 1993). It also is known that intermacromolecular complexes can be formed by mixing solutions of two complementary polymers. Such complexes are generally stabilized by electrostatic interactions (polyanion-polycation) and/or hydrogen bonds (polyacid-polybase) between the polymers involved, and/or by hydrophobic interactions between the polymers in an aqueous surrounding (Krupers et al., *Eur. Polym J.* 32:785-790, 1996). For example, mixing solutions of polyacrylic acid (PAAc) and polyethylene oxide (PEO) under the proper conditions results in the formation of complexes based mostly on hydrogen bonding. Dissociation of these complexes at physiologic conditions has been used for delivery of free drugs (i.e., non-PEGylated). Complexes of complementary polymers have been formed from homopolymers and copolymers.

Numerous reagents for PEGylation are known as are PEG moiety (PEGylated) therapeutic proteins. Such reagents include, but are not limited to, reaction of the polypeptide with N-hydroxysuccinimidyl (NHS) activated PEG, succinimidyl mPEG, $mPEG_2$-N-hydroxysuccinimide, mPEG succinimidyl alpha-methylbutanoate, mPEG succinimidyl propionate, mPEG succinimidyl butanoate, mPEG carboxymethyl 3-hydroxybutanoic acid succinimidyl ester, homobifunctional PEG-succinimidyl propionate, homobifunctional PEG propionaldehyde, homobifunctional PEG butyraldehyde, PEG maleimide, PEG hydrazide, p-nitrophenyl-carbonate PEG, mPEG-benzotriazole carbonate, propionaldehyde PEG, mPEG butryaldehyde, branched $mPEG_2$ butyraldehyde, mPEG acetyl, mPEG piperidone, mPEG methylketone, mPEG "linkerless" maleimide, mPEG vinyl sulfone, mPEG thiol, mPEG orthopyridylthioester, mPEG orthopyridyl disulfide, Fmoc-PEG-NHS, Boc-PEG-NHS, vinylsulfone PEG-NHS, acrylate PEG-NHS, fluorescein PEG-NHS, and biotin PEG-NHS (see, e.g., Monfardini et al., *Bioconjugate Chem.* 6:62-69, 1995; Veronese et al., *J. Bioactive Compatible Polymers* 12:197-207, 1997; U.S. Pat. Nos. 5,672,662; 5,932,462; 6,495,659; 6,737,505; 4,002, 531; 4,179,337; 5,122,614; 5,324,844; 5,446,090; 5,612, 460; 5,643,575; 5,766,581; 5,795,569; 5,808,096; 5,900, 461; 5,919,455; 5,985,263; 5,990,237; 6,113,906; 6,214, 966; 6,258,351; 6,340,742; 6,413,507; 6,420,339; 6,437, 025; 6,448,369; 6,461,802; 6,828,401; 6,858,736; U.S. 2001/0021763; U.S. 2001/0044526; U.S. 2001/0046481; U.S. 2002/0052430; U.S. 2002/0072573; U.S. 2002/ 0156047; U.S. 2003/0114647; U.S. 2003/0143596; U.S. 2003/0158333; U.S. 2003/0220447; U.S. 2004/0013637; US 2004/0235734; WO0500360; U.S. 2005/0114037; U.S. 2005/0171328; U.S. 2005/0209416; EP 01064951; EP 0822199; WO 00176640; WO 0002017; WO 0249673; WO 9428024; and WO 0187925).

In one example, the polyethylene glycol has a molecular weight ranging from about 3 kD to about 50 kD, and typically from about 5 kD to about 30 kD. Covalent attachment of the PEG to the drug (known as "PEGylation") can be accomplished by known chemical synthesis techniques. For example, the PEGylation of protein can be accomplished by reacting NHS-activated PEG with the protein under suitable reaction conditions.

While numerous reactions have been described for PEGylation, those that are most generally applicable confer directionality, use mild reaction conditions, and do not necessitate extensive downstream processing to remove toxic catalysts or bi-products. For instance, monomethoxy PEG (mPEG) has only one reactive terminal hydroxyl, and thus its use limits some of the heterogeneity of the resulting PEG-protein product mixture. Activation of the hydroxyl group at the end of the polymer opposite to the terminal methoxy group is generally necessary to accomplish efficient protein PEGylation, with the aim being to make the derivatised PEG more susceptible to nucleophilic attack. The attacking nucleophile is usually the epsilon-amino group of a lysyl residue, but other amines also can react (e.g. the N-terminal alpha-amine or the ring amines of histidine) if local conditions are favorable. A more directed attachment is possible in proteins containing a single lysine or cysteine. The latter residue can be targeted by PEG-maleimide for thiol-specific modification. Alternatively, PEG hydrazide can be reacted with a periodate oxidized hyaluronan-degrading enzyme and reduced in the presence of $NaCNBH_3$. More specifically, PEGylated CMP sugars can be reacted with a hyaluronan-degrading enzyme in the presence of appropriate glycosyltransferases. One technique is the "PEGylation" technique where a number of polymeric molecules are coupled to the polypeptide in question. When using this technique the immune system has difficulties in recognizing the epitopes on the polypeptide's surface responsible for the formation of antibodies, thereby reducing the immune response. For polypeptides introduced directly into the circulatory system of the human body to give a particular physiological effect (i.e. pharmaceuticals) the typical potential immune response is an IgG and/or IgM response, while polypeptides which are inhaled through the respiratory system (i.e. industrial polypeptide) potentially can cause an IgE response (i.e. allergic response). One of the theories explaining the reduced immune response is that the polymeric molecule(s) shield(s) epitope(s) on the surface of the polypeptide responsible for the immune response leading to antibody formation. Another theory or at least a partial factor is that the heavier the conjugate is, the more reduced immune response is obtained.

Typically, to make the PEGylated modified u-PA polypeptide provided herein, PEG moieties are conjugated, via covalent attachment, to the polypeptides. The Modified u-PA polypeptides for PEGylation can be prepared without the C122S replacement; instead the C122 can serve as a site for conjugate to a PEG moiety and/or for forming a desired disulfide bond, such as for a two chain activated form or an dimer.

Techniques for PEGylation include, but are not limited to, specialized linkers and coupling chemistries (see, e.g., Harris, *Adv. Drug Deliv. Rev.* 54:459-476, 2002), attachment of multiple PEG moieties to a single conjugation site (such as via use of branched PEGs; see, e.g., Veronese et al., *Bioorg. Med. Chem. Lett.* 12:177-180, 2002), site-specific PEGylation and/or mono-PEGylation (see, e.g., Chapman et al., *Nature Biotech.* 17:780-783, 1999), and site-directed enzymatic PEGylation (see, e.g., Sato, *Adv. Drug Deliv. Rev.*, 54:487-504, 2002). Methods and techniques described in the art can produce proteins having 1, 2, 3, 4, 5, 6, 7, 8, 9, 10 or more than 10 PEG or PEG derivatives attached to a single protein molecule (see, e.g., U.S. Patent Publication No. 2006/0104968).

b. Fusion Proteins and Other Conjugates

Provided herein are conjugates of u-PA and the modified u-PA polypeptides provided herein. Exemplary such conjugates are the fusion proteins exemplified in Examples 14-16. As described herein, some of the conjugates when activated by cleavage of an included activation polypeptide forms a two-chain activated u-PA polypeptide; others, such as those that contain $F_c$ domains can form tow chains via linkage of the $F_c$ domains. Others contain sequences, such as SUMO and HIS-SUMO that facilitate expression and isolation/purification. Examples 14 and 15, and also FIGS. 1-4, describe and depict resulting conjugates. For use as pharmaceuticals, the modified u-PA polypeptides generally are provided in activated form, such as a two chain activated form. It is understood that the following discussion describes the fusion polypeptides that can include signal sequences and other regulatory sequences that will not appear in the product as produced. In particular, the fusion polypeptides can include activation sequences, whereby upon cleavage, the resulting polypeptide is a two chain activated polypeptide. It is the activated forms of the polypeptides that, in general, will be the pharmaceutical product administered to a subject.

i. Exemplary Fusion Proteins and Other Protein Conjugates

The modified u-PA polypeptides provided herein can be fused to other polypeptides and portions thereof and to moieties to confer desired properties, such as increased serum half-life, and/or reduced immunogenicity, and/or other properties. These include, for example, fusion to albumin, fusion to targeting moieties, such as antibodies and antigen binding fragments thereof, fusion to immunoglobulins, Fc fusions, modification of glycosylation patterns, farnesylation and other such modifications (see, Strohl (2015) *BioDrugs* 29:215-239 for a review of a variety of fusion proteins for improving pharmacokinetic properties of therapeutic proteins). Any such modalities for altering pharmacological properties of therapeutics can be applied to the modified u-PA polypeptides provided herein. Generally, where the modification is a polypeptide or portion thereof, the modified u-PA is produced as a fusion protein. For non-polypeptidic modifications, such as pegylation, modification is effected on isolated protein. The modified u-PA polypeptides include those that have Cys at residue 122 (by chymotrypsin number), to provide sites for post-translational or post-purification modification. The modified u-PA polypeptides include those that are full-length and catalytically active portions thereof, such as the protease domain, or the mature polypeptide or the activated two-chain polypeptide.

Fusion proteins containing a modified u-PA polypeptide provided herein and one or more other polypeptides also are provided. Pharmaceutical compositions containing such fusion proteins formulated for administration by a suitable route are provided. Fusion proteins are formed by linking in any order a modified u-PA polypeptide and another polypeptide, such as an antibody or fragment thereof, growth factor, receptor, ligand and other such agent for the purposes of facilitating the purification of a protease, altering the pharmacodynamic properties of a modified u-PA polypeptide by directing the u-PA polypeptide to a targeted cell or tissue, and/or increasing the expression or secretion of a u-PA polypeptide. Within a u-PA polypeptide fusion protein, the u-PA polypeptide can be all or a catalytically active portion thereof of a u-PA polypeptide or the catalytically active portion of a u-PA polypeptide and a further portion of u-PA that is not full-length u-PA. Fusion proteins provided herein retain substantially all of their specificity and/or selectivity for complement protein C3. Generally, u-PA fusion polypeptides retain at least about 30%, 40%, 50%, 60%, 70%, 80%, 85%, 90% or 95% substrate specificity and/or selectivity compared with a non-fusion u-PA polypeptide, including 96%, 97%, 98%, 99% or greater substrate specificity compared with a non-fusion u-PA polypeptide.

ii. Construct Generation

A u-PA fusion protein can be produced by standard recombinant techniques. For example, DNA fragments encoding the different polypeptide sequences can be ligated together in-frame in accordance with conventional techniques, e.g., by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. In another embodiment, the fusion gene can be synthesized by conventional techniques including automated DNA synthesizers. Alternatively, PCR amplification of gene fragments can be carried out using anchor primers that give rise to complementary overhangs between two consecutive gene fragments that can subsequently be annealed and reamplified to generate a chimeric gene sequence (see, e.g., Ausubel et al. (eds.) CURRENT PROTOCOLS IN MOLECULAR BIOLOGY, John Wiley & Sons, 1992). Many expression vectors are commercially available that encode a fusion moiety (e.g., a his tag, SUMO polypeptide, or GST polypeptide). A u-PA-encoding nucleic acid can be cloned into such an expression vector such that the fusion moiety is linked in-frame to the u-PA polypeptide.

Exemplary expression vectors include any mammalian expression vector such as, for example, pCMV. For bacterial expression, such vectors include pBR322, pUC, pSKF, pET23D, and fusion vectors such as MBP, GST and LacZ. Other eukaryotic vectors, for example any containing regulatory elements from eukaryotic viruses, can be used as eukaryotic expression vectors. These include, for example, SV40 vectors, papilloma virus vectors, and vectors derived from Epstein-Bar virus. Exemplary eukaryotic vectors include pMSG, pAV009/A+, pMT010/A+, pMAMneo-5, baculovirus pDSCE, and any other vector allowing expression of proteins under the direction of the CMV promoter, SV40 early promoter, SV40 late promoter, metallothionein promoter, murine mammary tumor virus promoter, Rous sarcoma virus promoter, polyhedron promoter, or other promoters shown effective for expression in eukaryotes.

iii. Signal Sequence u-PA fusion proteins can contain a signal peptide (SP or signal sequence or localization signal or leader peptide) for directing transport of the protease. Signal peptides are sequence motifs found at the N-terminus of nascent proteins that target proteins for translocation across the endoplasmic reticulum membrane to their specific destination within the cell, or outside the cell if the proteins are to be secreted. Thus, SP selection and modifying the SP influences protein targeting (Zhang et al. (2005) *J Gene Med* 7:354-365). Optimized SPs have been developed for more efficient activity. Computational models and algorithms have been developed to predict SP efficacy and define SP consensus sequences (Burdukiewicz et al. (2018) Int J Mol Sci 19(12): 3709; Peason et al. (1988) *Proc. Natl. Acad. Sci. U.S.A.* 85:2444-2448).

Various proteins are known to have SPs, including but not limited to: receptors (nuclear, 4 transmembrane, G protein-coupled and tyrosine kinase), cytokines (chemokines), hormones (growth and differentiation factors), neuropeptides and vasomediators, protein kinases, phosphatases, phospholipases, phosphodiesterases, nucleotide cyclases, matrix molecules (adhesion, cadherin, extracellular matrix molecules, integrin, and selectin), G proteins, ion channels (calcium, chloride, potassium, and sodium), proteases, transporter/pumps (amino acid, protein, sugar, metal and vitamin; calcium, phosphate, potassium, and sodium) and regulatory proteins. In some examples the original signal peptide is optimized for the secretion of the protein in the desired host cell selected for production. A u-PA polypeptide, such as a modified u-PA protease domain provided herein, can be fused, directly or indirectly, to a non-uPA signal peptide for u-PA targeting.

The signal peptides may be signal peptides of antibodies such as the signal peptides of the heavy chains of antibodies and the light chain of antibodies. The isotype of the antibody may comprise, but is not limited, to IgG, IgM, IgD, IgA and IgE. Thus, the heavy chain may comprise gamma, mu, delta, alpha and epsilon heavy chains, and the light chain may comprise a kappa or a lambda light chain. The u-PA fusion proteins set forth herein can be prepared with an antibody signal peptide such as the mouse immunoglobulin light chain kappa (κ) leader signal peptide sequence, such as the signal sequence set forth in SEQ ID NO: 999.

Other exemplary signal peptides are those derived from human interleukin-2 (IL-2) which are used extensively for research and protein production (Bamford et al. (1998) *J Immunol* 160:4418; Komada et al. (1999) *Biol Pharm Bull* 22:846). Modified IL-2 SPs with increased basicity and hydrophobicity have been developed that increased secretion of fused proteins by up to 3.5 fold (Zhang et al. (2005) *J. Gene Med.* 7:354). The u-PA fusion proteins herein can be prepared, for example, with an IL-2 signal peptide, such as the human IL2 Signal Peptide (hIL2SP), such as, for example, the signal sequence set forth in SEQ ID NO: 1000.

Exemplary u-PA fusion proteins set forth herein can contain a signal peptide for directing transport of the protease. For example, the u-PA fusion polypeptides set forth as SEQ ID NOs:1004, 1005, 1010, 1011, 1014-1018, 1036 and 1040 contain a mouse immunoglobulin light chain kappa (κ) leader signal peptide sequence (SEQ ID NO: 999). In another example, the u-PA fusion polypeptides set forth as SEQ ID NOs:1006-1009, 1012, 1013, 1034 and 1035 contain a human IL2 Signal Peptide (hIL2SP) sequence (SEQ ID NO: 1000).

iv. Exemplary Fusion Proteins and Peptide Linkers

Linkage of a modified u-PA polypeptide and another polypeptide can be effected directly, or indirectly via a linker. In one example, linkage can be by chemical linkage, such as via heterobifunctional agents or thiol linkages or other such linkages. Fusion of a u-PA polypeptide to another polypeptide can be to the N- or C-terminus of the modified u-PA polypeptide, such as the modified u-PA protease domain. Non-limiting examples of polypeptides that can be used in fusion proteins with a u-PA polypeptide provided herein include, for example, a Fc domain from immunoglobulin G, serum albumin (i.e., human serum albumin), scFv that binds to Collagen IIm (C2scFv), Hyaluronic Acid Binding Domain (HABD), GST (glutathione S-transferase) polypeptide, a his tag (i.e., HHHHHH), a Small Ubiquitin-like Modifier (SUMO) tag, the influenza hemagglutinin (HA) tag polypeptide and its antibody 12CA5, and/or a heterologous signal sequence (e.g., from thrombin or a mouse Ig kappa chain V-III region (IgGκ) or human Interleukin-2 (hIL2)). The fusion proteins can contain additional components, such as *E. coli* maltose binding protein (MBP), that aid in uptake of the protein by cells (see, International PCT application Publication No. WO 01/32711).

Peptide linkers can be included in u-PA fusion proteins. In one example, peptide linkers can be fused to the C-terminal end of a first polypeptide and the N-terminal of a second polypeptide. This structure can be repeated a plurality of times such that at least one, and optionally 2, 3, 4 or more polypeptides are linked to one another via peptide linkers at their respective termini. For example, a fusion protein can include a sequence X-Y-Z, where X is the wild-type or modified u-PA catalytic domain, Y is a peptide linker, and Z is all or part of fusion partner (e.g., HSA, Fc, HABD, or C2 scFv). In some instances, X is all of a modified u-PA including the N-terminus of u-PA, and the protease domain of u-PA. In other instances, X is part of a modified u-PA including the 12 amino acids directly upstream of the u-PA protease domain, and the u-PA protease domain. In another example, the polypeptide can include the sequence A-X-Y-Z, where "A" is another fusion partner, such as a polypeptide, such as SUMO or HIS-SUMO, that facilitates expression and/or isolation of the resulting polypeptide.

Peptide linkers generally include Gly, Ser, and combinations thereof, or Ala and Proline. Linkers generally contain from two up to 20 or 25 residues. Examples of peptide linkers include, but are not limited to: -Gly-Gly-, GSG, AGS (SEQ ID NO: 1003), GGGGS (SEQ ID NO:1001), GGSSGG (SEQ ID NO:1002), SSSSG (SEQ ID NO:1024), GKSSGSGSESKS (SEQ ID NO:1025), GGST-SGSGKSSSEGKG (SEQ ID NO: 1026), GST-SGSGKSSSEGSGSTKG (SEQ ID NO: 1027), GST-SGSGKPGSGEGSTKG (SEQ ID NO: 1028), EGKSSGSGSESKEF (SEQ ID NO:1029), or AlaAlaProAla or (AlaAlaProAla)n (SEQ ID NO:1030), where n is 1 to 6, such as 1, 2, 3, 4, 5 or 6.

Linking moieties are described, for example, in Huston et al. (1988)*Proc. Natl. Acad. Sci. U.S.A.* 85:5879-5883, Whitlow et al. (1993) *Protein Engineering* 6:989-995, and Newton et al., (1996) *Biochemistry* 35:545-553. Other suitable peptide linkers include any of those described in U.S. Pat. Nos. 4,751,180 or 4,935,233. A polynucleotide encoding a desired peptide linker can be inserted between, and in the same reading frame as a polynucleotide encoding all or part of a u-PA including the u-PA protease domain, using any suitable conventional technique. In one example, the fusion protein contains a u-PA polypeptide, for example a u-PA protease domain, and a fusion partner, such as HSA, Fc, HABD, or C2 scFv, separated by a peptide linker(s).

Exemplary u-PA fusion polypeptides include a linker at the C-terminus of the u-PA protease domain which links the u-PA protease domain to a C-terminal fusion partner, such as HSA or Fc. u-PA-linker-Fc and u-PA-linker-HSA molecules optionally can contain an epitope tag and/or a signal for expression and secretion. An exemplary u-PA-linker-Fc fusion protein is set forth in SEQ ID NO: 1018, which contains mouse immunoglobulin light chain kappa (κ) leader signal peptide sequence (SEQ ID NO: 999), HIS-SUMO (SEQ ID NO: 990), a u-PA protease domain (SEQ ID NO: 21), a linker (SEQ ID NO: 1002), and an Fc fragment of the human IgG1 heavy chain (SEQ ID NO:992).

In other examples, the exemplary u-PA fusion proteins are u-PA-linker-HSA fusion polypeptides, such as the fusion proteins set forth as SEQ ID NOs:1015-1017. For example, the fusion polypeptide set forth in SEQ ID NO:1015 contains mouse immunoglobulin light chain kappa (κ) leader signal peptide sequence (SEQ ID NO: 999), the N-terminal domain of u-PA (SEQ ID NO: 1042), the wild-type u-PA activation sequence (SEQ ID NO: 997), a u-PA protease domain (SEQ ID NO: 987), a linker (SEQ ID NO: 1002), and HSA (SEQ ID NO:991). In another example, the fusion polypeptide set forth in SEQ ID NO:1016 contains mouse immunoglobulin light chain kappa (κ) leader signal peptide sequence (SEQ ID NO: 999), a furin activation sequence in the u-PA activation sequence (SEQ ID NO:996), a u-PA protease domain (SEQ ID NO: 21), a linker (SEQ ID NO: 1002), and HSA (SEQ ID NO:991). In another example, the fusion polypeptide set forth in SEQ ID NO:1017 contains mouse immunoglobulin light chain kappa (κ) leader signal peptide sequence (SEQ ID NO: 999), HIS-SUMO (SEQ ID NO: 990), a u-PA protease domain (SEQ ID NO: 21), a linker (SEQ ID NO: 1002), and HSA (SEQ ID NO:991).

In other examples, the linker is at the N-terminus of the u-PA protease domain and links the protease domain to an N-terminal fusion partner. For example, the fusion protein may contain an N-terminal Fc linked to u-PA. An exemplary FC-linker-u-PA fusion polypeptide is set forth in SEQ ID NO: 1004, which contains mouse immunoglobulin light chain kappa (κ) leader signal peptide sequence (SEQ ID NO: 999), an Fc fragment of the human IgG1 heavy chain (SEQ ID NO:992), a linker (SEQ ID NO: 1003), the wild-type u-PA activation sequence (SEQ ID NO: 997), and a u-PA protease domain (SEQ ID NO:987).

v. Fusion Partners

Fusion proteins, such as fusion proteins containing fusion to Fc, fusion to human serum albumin (HSA), fusion to a single-chain fragment variable (scFv) antibody, such as scFv that binds Collagen II (C2scFv), fusion to HABD, and fusion to other polypeptides, are known modifications for improving pharmacokinetics of peptide or biologic drugs. Also among these is conjugation to either linear or branched-chain monomethoxy poly-ethylene glycol (PEG), resulting in increases in the molecular mass and hydrodynamic radius, and a decrease in the rate of glomerular filtration by the kidney. Another approach to for improving pharmacokinetic parameters includes modification of glycosylation patterns, resulting in reduced clearance and extension of half-life.

Exemplary u-PA fusion polypeptides include placement of the fusion partner (i.e., HSA, HABD, C2 scFv or Fc) N-terminal to the u-PA protease domain or C-terminal to the u-PA protease domain. An exemplary u-PA fusion protein where the fusion partner is N-terminal to the u-PA protease domain is set forth in SEQ ID NO: 1004. Exemplary u-PA fusion proteins where the fusion partner is C-terminal to the u-PA protease domain are set forth in SEQ ID NOs: 1006-1018.

(a) Fc Domain

Some examples of u-PA fusion proteins include the heavy chain of an immunoglobulin polypeptide, most usually the constant domains of the heavy chain. Exemplary sequences of heavy chain constant regions for human IgG sub-types are set forth in SEQ ID NO: 45 (IgG1), SEQ ID NO: 1020 (IgG2), SEQ ID NO: 1021 (IgG3), and SEQ ID NO: 1022 (IgG4). For example, for the exemplary heavy chain constant region set forth in SEQ ID NO: 45, the $C_H1$ domain corresponds to amino acids 1-98, the hinge region corresponds to amino acids 99-110, the $C_H2$ domain corresponds to amino acids 111-223, and the CH3 domain corresponds to amino acids 224-330.

In one example, a u-PA fusion protein can include the Fc region of an immunoglobulin polypeptide, such as human immunoglobulin. Typically, such a fusion retains at least a functionally active hinge, $C_H2$ and $C_H3$ domains of the constant region of an immunoglobulin heavy chain. For example, a full-length Fc sequence of IgG1 includes amino acids 105-330 of the sequence set forth in SEQ ID NO:45. Exemplary Fc sequences for hIgG1 are set forth in SEQ ID NO: 992 and 1023, and contain almost all of the hinge sequence corresponding to amino acids 100-110 of SEQ ID NO:45, and the complete sequence for the $C_H2$ and $C_H3$ domain as set forth in SEQ ID NO:45. Another exemplary Fc polypeptide is set forth in PCT application WO 93/10151, and is a single chain polypeptide extending from the N-terminal hinge region to the native C-terminus of the Fc region of a human IgG1 antibody (SEQ ID NO:50). The precise site at which the linkage is made is not critical: particular sites are well known and can be selected in order to optimize the biological activity, or stability of the u-PA polypeptide. For example, other exemplary Fc polypeptide sequences begin at amino acid C109 or P113 of the sequence set forth in SEQ ID NO: 45 (see e.g., U.S. Pub. No. 2006/0024298).

In addition to hIgG1 Fc, other Fc regions also can be included in the u-PA fusion proteins provided herein. For example, where effector functions mediated by Fc/FcγR interactions are to be minimized, fusion with IgG isotypes that poorly recruit complement or effector cells, such as for example, the Fc of IgG2 or IgG4, is contemplated. Additionally, the Fc fusions can contain immunoglobulin sequences that are substantially encoded by immunoglobulin genes belonging to any of the antibody classes, including, but not limited to IgG (including human subclasses IgG1, IgG2, IgG3, or IgG4), IgA (including human subclasses IgA1 and IgA2), IgD, IgE, and IgM classes of antibodies. Further, linkers can be used to covalently link Fc to another polypeptide to generate a Fc chimera.

Modified Fc domains also are contemplated herein for use in chimeras with u-PA fusion polypeptides. In some examples, the Fc region is modified such that it exhibits altered binding to an FcR so has to result altered (i.e. more or less) effector function than the effector function of an Fc region of a wild-type immunoglobulin heavy chain. Thus, a modified Fc domain can have altered affinity, including but not limited to, increased or low or no affinity for the Fc receptor. For example, the different IgG subclasses have different affinities for the FcγRs, with IgG1 and IgG3 typically binding substantially better to the receptors than IgG2 and IgG4. Different FcγRs mediate different effector functions. FcγR1, FcγRIIa/c, and FcγRIIIa are positive regulators of immune complex triggered activation, characterized by having an intracellular domain that has an immunoreceptor tyrosine-based activation motif (ITAM). FcγRIIb, however, has an immunoreceptor tyrosine-based inhibition motif (ITIM) and is therefore inhibitory. In some instances, an u-PA polypeptide-Fc fusion protein provided herein can be modified to enhance binding to the complement protein C1q. Further, an Fc can be modified to alter its binding to FcRn, thereby improving the pharmacokinetics of an u-PA-Fc fusion polypeptide. Thus, altering the affinity of an Fc region for a receptor can modulate the effector functions and/or pharmacokinetic properties associated by the Fc domain. Modified Fc domains are known to one of skill in the art and described in the literature, see e.g. U.S. Pat. No. 5,457,035; U.S. Patent Publication No. US 2006/0024298; and International Patent Publication No. WO 2005/063816 for exemplary modifications.

In some examples, a u-PA polypeptide multimer is formed. Typically, a polypeptide multimer is a dimer of two chimeric proteins created by linking, directly or indirectly, two of the same or different u-PA polypeptides, such as a u-PA protease domain, to an Fc polypeptide. In some examples, a gene fusion encoding the u-PA-Fc fusion protein is inserted into an appropriate expression vector. The resulting u-PA-Fc fusion proteins can be expressed in host cells transformed with the recombinant expression vector, and allowed to assemble much like antibody molecules, where interchain disulfide bonds form between the Fc moieties to yield divalent u-PA polypeptides.

u-PA fusion polypeptides containing Fc regions also can be engineered to include a tag with metal chelates or other epitope. The tagged domain can be used for rapid purification by metal-chelate chromatography, and/or by antibodies, to allow for detection of western blots, immunoprecipitation, or activity depletion/blocking in bioassays.

Exemplary u-PA-Fc fusion polypeptides include fusion of the u-PA protease domain and Fc. Exemplary u-PA-Fc fusion proteins are set forth in SEQ ID NOs: 1004, 1006, 1010, 1011, 1012 and 1018. The u-PA-Fc molecules optionally can contain an epitope tag or a signal for expression and secretion. For example, the exemplary u-PA-Fc fusion polypeptides set forth as SEQ ID NOs:1004, 1010, and 1011 contain mouse immunoglobulin light chain kappa (κ) leader signal peptide sequence (SEQ ID NO: 999), an Fc fragment of the human IgG1 heavy chain (SEQ ID NO:992) and a u-PA protease domain (SEQ ID NO: 21 or 987) either N-terminal (SEQ ID NO:1004) or C-terminal (SEQ ID NOs:1010 and 1011) to the Fc. In another example, the exemplary u-PA-Fc fusion polypeptides set forth as SEQ ID NOs:1006 and 1012 contain human IL2 Signal Peptide (hIL2SP) sequence (SEQ ID NO: 1000), a u-PA protease domain (SEQ ID NO: 5 or 21), and an Fc fragment of the human IgG1 heavy chain (SEQ ID NO:992) N-terminal to the u-PA protease domain.

(b) Serum Albumin u-PA fusion proteins can be generated with albumin as a fusion partner in order to increase the half-life, stability, bioavailability, distribution and/or improve the pharmacokinetics of u-PA. Numerous products linked to human serum albumin (HSA) are approved for use as therapeutics, including use as cancer therapeutics and for treatment of type 2 diabetes (AlQahtani et al. (2019) *Biomed and Pharmacotherapy* 113:108750; Roscoe et al., (2018) *Mol. Pharmaceutics* 151:15046-5047; Strohl, W. R. (2015) *BioDrugs* 4:215-239). In some examples, the mature HSA protein, lacking the signal sequence and activation sequence is fused to a protein of interest. In some examples of a u-PA fusion protein, serum albumin, such as human serum albumin (HSA), is conjugated to the u-PA, such as the u-PA protease domain. An exemplary HSA is set forth in SEQ ID NO: 991.

u-PA-HSA fusion polypeptides include fusion of the u-PA protease domain and HSA. Exemplary u-PA-HSA fusion proteins are set forth in SEQ ID NOs: 1007 and 1013-1017. u-PA-HSA molecules optionally can contain an epitope tag and/or a signal for expression and secretion. For example, the exemplary u-PA-HSA fusion polypeptides set forth as SEQ ID NOs:1014-1017 contain mouse immunoglobulin light chain kappa (κ) leader signal peptide sequence (SEQ ID NO: 999), a u-PA protease domain (SEQ ID NO: 987 or 21), and a C-terminal HSA (SEQ ID NO:991). In another example, the exemplary u-PA-HSA fusion polypeptide set forth as SEQ ID NO:1013 contains human IL2 Signal Peptide (hIL2SP) sequence (SEQ ID NO: 1000), the u-PA protease domain (SEQ ID NO:5), and a C-terminal HSA (SEQ ID NO:991).

(c) scFv that Binds Collagen II (C2scFv)

Recombinant antibody fragments in the form of single-chain fragment variable (scFv) antibodies, such as a scFv that binds Collagen II (C2scFv), can be used as a fusion partner with u-PA. scFv antibodies produced from phage display can be fused to markers, or active or therapeutic proteins (Ahmad et al. (2012) Clin Dev Immunol 2012: 980250). Fusion of scFvs can be used to increase yield and activity of conjugated proteins (Martin et al., (2006) *BMC Biotech* 6:46).

Single-chain fragment variable antibodies comprise heavy ($V_H$) and light ($V_L$) chain variable regions joined by a peptide linker or disulfide bond (Glockshuber et al. (1990) *Biochemistry* 29(6):1362-1367). The peptide linker plays a critical role in folding of the polypeptide chain. Commonly utilized linkers comprise Gly and Ser residues for flexibility or Glu and Lys to enhance solubility (Whitlow et al. (1993) *Protein Engineering* 6(8):989-995).

scFvs can be fused to proteins for specific delivery to antigen-presenting cells (Ahmad et al. (2012) Clin Dev Immunol 2012:980250). For example, the scFv can be generated to target collagen II, such as for uses as research agents, and as a delivery agent of therapeutic molecules to sites expressing human collagen II. For example, the scFv is an isolated monoclonal antibody or fragment thereof that binds human collagen II, comprising a VH region and a VL region, where the C2scFv comprises an amino acid sequence having a sequence shown in SEQ ID NO: 993.

Exemplary u-PA-C2scFv fusion polypeptides include fusion of the u-PA protease domain and C2scFv. An exemplary u-PA-C2scFv fusion protein is set forth in SEQ ID NO: 1008. u-PA-C2scFv molecules optionally can contain an epitope tag or a signal for expression and secretion. For example, the exemplary u-PA-C2scFv fusion polypeptide set forth as SEQ ID NO:1008 contains a human IL2 Signal Peptide (hIL2SP) sequence (SEQ ID NO: 1000), a u-PA protease domain (SEQ ID NO:21), and a C-terminal C2scFv (SEQ ID NO:993).

(d) Hyaluronic Acid Binding Domain (HABD)

In some examples, the u-PA fusion proteins contain a HABD fusion partner, such as Tumor Necrosis factor-Stimulated Gene-6 (TSG-6), such as the TSG-6 set forth as SEQ ID NO: 994 (corresponding to amino acids 32-134 of human TSG-6; NCBI No. NP_009046.2). u-PA fusion proteins can be generated with a HABD, such as TSG-6, as a fusion partner in order to increase the half-life, stability, bioavailability, distribution and/or improve the pharmacokinetics of u-PA.

Tumor necrosis factor-Stimulated Gene-6 (TSG-6, tumor necrosis factor alpha-induced protein 6, TNFAIP6; NCBI No. NP_009046.2) is a ~35 kDa secreted glycoprotein composed of a single N-terminal link module and C-terminal CUB domain. Expression of TSG-6 is induced in many cell types by inflammatory mediators, including cytokines and growths factors. Via its link module, which has been reported to contain approximately amino acids 35-132, TSG-6 is a potent inhibitor of polymorphonuclear leukocyte migration. TSG-6 forms a stable complex with the serine protease inhibitor Inter-alpha-Inhibitor (IαI) and potentiates the anti-plasmin activity of IαI. TSG-6 also is important for the formation and remodeling of HA-rich pericellular coats and extracellular matrices.

Exemplary u-PA-HABD fusion polypeptides include fusion of the u-PA protease domain and HABD. An exemplary u-PA-HABD fusion protein is set forth in SEQ ID NO: 1009. u-PA-HABD molecules can, optionally, contain an epitope tag or a signal for expression and secretion. For example, the exemplary u-PA-HABD fusion polypeptide set forth as SEQ ID NO:1009 contains human IL2 Signal Peptide (hIL2SP) sequence (SEQ ID NO: 1000), a u-PA protease domain (SEQ ID NO:21), and a C-terminal HABD (SEQ ID NO:994).

v. Activation Sequences (Sites)

Exemplary u-PA fusion proteins contain a site (sequence) for u-PA activation. For example, u-PA fusion proteins comprise wild-type u-PA sequence for auto-activation; contain furin sequence for activation during protein expression; or are activated after secretion signal cleavage, all generating the activated u-PA protease.

(a) Furin

Furin proteins have been implicated in the endoproteolytic maturation processing of inactive precursor proteins at single, paired or multiple basic consensus sites within the secretory pathway (Nakayama (1997) *Biochem*. J. 327:625-635; Seidah and Chretien, *Current Opinions in Biotechnology* (1997) 8:602-607). Upon transit of a newly synthesized precursor protein from the endoplasmic reticulum to the Golgi compartment, the propeptide is autocatalytically removed in a two-step processing event at a furin cleavage motif (Leduc et al. (1992) *J. Biol. Chem* 267:14304-14308; Anderson et al. (1997) EMBO 1508-1518). Furin requires a R-X-X-R site for cleavage, and optimum processing occurs at a R-X-K/R-R motif (Molloy et al. (1992) *J. Biol Chem* 267:16396-16402). Exemplary u-PA activation sequences, containing the furin RRKR cleavage sites, are set forth in SEQ ID NOs: 995 and 996.

u-PA fusion proteins may include a furin activation sequence (site) N-terminal to the u-PA protease domain, so that u-PA protein is activated during expression. u-PA activation during expression, such as by inclusion of a furin activation sequence in the u-PA activation sequence, is intended to remove the need for an activation step during downstream processing.

u-PA fusion polypeptides including a furin activation sequence and the u-PA protease domain were generated. Exemplary furin-u-PA proteins are set forth in SEQ ID NOs: 1010, 1014 and 1016. Furin activated u-PA molecules optionally contain a fusion partner, and/or a signal for expression and secretion. For example, the exemplary u-PA fusion proteins set forth as SEQ ID NOs:1014 and 1016 contain mouse immunoglobulin light chain kappa (κ) leader signal peptide sequence (SEQ ID NO: 999), a furin activation sequence in the u-PA activation sequence (SEQ ID NO: 995 or 996), the u-PA protease domain (SEQ ID NO: 21 or 987), and HSA (SEQ ID NO:991). The u-PA fusion protein set forth as SEQ ID NO: 1014 further contains the N-terminus of u-PA (set forth as amino acids 21-178 of SEQ ID NO:1 or SEQ ID NO: 1042), N-terminal to the furin-u-PA protease domain with the u-PA protease domain set forth in SEQ ID NO: 987. In another example, u-PA fusion protein set forth as SEQ ID NO:1010 contains mouse immunoglobulin light chain kappa (κ) leader signal peptide sequence (SEQ ID NO: 999), a furin activation sequence in the u-PA activation sequence (SEQ ID NO: 995), the u-PA protease domain (SEQ ID NO: 21), and Fc (SEQ ID NO:992).

(b) u-Pa u-PA zymogen activation occurs by cleavage of a single peptide bond N-terminal to the u-PA catalytic domain, initiating a conformational change in the protein. u-PA constructs generated herein can contain the 12 amino acid u-PA activation sequence (SEQ ID NO: 997) or a modified form thereof (SEQ ID NO: 998) or can contain an extended portion of the u-PA N-terminus including the activation sequence, such that the u-PA comprises the full-length mature polypeptide, such as the polypeptide set forth in SEQ ID NO: 3. In other examples, the u-PA comprises the N-terminus, such as the N-terminal region of u-PA set forth as amino acids 21-178 of SEQ ID NO:1 or SEQ ID NO: 1042, and the 12 amino acid u-PA activation sequence (SEQ ID NO: 997) or a modified form of the u-PA activation sequence (SEQ ID NO: 998).

Fusion proteins containing the modified u-PA polypeptides provided herein have been prepared. u-PA fusion polypeptides including the wild-type or a modified u-PA activation sequence and the u-PA protease domain were generated. Exemplary u-PA proteins containing the wild-type u-PA activation sequence for activation are set forth in SEQ ID NOs: 1004, 1005, 1011, and 1015. The fusion peptides optionally can contain a fusion partner, and/or a signal for expression and/or secretion. For example, the exemplary u-PA fusion protein set forth as SEQ ID NO:1004 contains mouse immunoglobulin light chain kappa (κ) leader signal peptide sequence (SEQ ID NO: 999), Fc (SEQ ID NO:992), the u-PA activation sequence (SEQ ID NO:995), and the u-PA protease domain (SEQ ID NO: 987). In a further example, the u-PA fusion protein set forth as SEQ ID NO: 1005 contains the full-length mature u-PA sequence (SEQ ID NO: 3 with the modified protease domain set forth in SEQ ID NO: 987) and an N-terminal mouse immunoglobulin light chain kappa (κ) leader signal peptide sequence (SEQ ID NO: 999). In a further example, the u-PA fusion protein set forth as SEQ ID NO: 1011 contains an N-terminal mouse immunoglobulin light chain kappa (κ) leader signal peptide sequence (SEQ ID NO: 999), the full-length mature u-PA sequence (SEQ ID NO: 3 with the modified protease domain set forth in SEQ ID NO: 987), and Fc (SEQ ID NO: 992). In another example, the u-PA fusion protein set forth as SEQ ID NO:1015 contains mouse immunoglobulin light chain kappa (κ) leader signal peptide sequence (SEQ ID NO: 999), the N-terminus of u-PA (set forth as amino acids 21-178 of SEQ ID NO:1) including the u-PA activation sequence, the u-PA protease domain (SEQ ID NO: 987), and HSA (SEQ ID NO:991). Modified u-PA polypeptides, such as those of SEQ ID NOs: 1006, 1007, 1009 and 1010, upon expression, demonstrated u-PA protease activity. Modified u-PA with a furin activation sequence N-terminal to u-PA with an Ig FC fusion at the C-terminus (such as set forth in SEQ ID NO: 1010) showed the highest activity.

vi. Purification Tags

Exemplary u-PA fusion proteins contain a tag for purification of the u-PA or u-PA fusion protein. Exemplary tags for purification of u-PA fusion proteins are set forth in Section F, above. Exemplary u-PA fusion proteins can comprise a SUMO or His sequence for purification.

(a) His Tag u-PA fusion proteins may include a His tag, such as the 6×His set forth in SEQ ID NO: 989, and the u-PA protease domain.

u-PA fusion polypeptides including a His purification tag and the u-PA protease domain were generated. Exemplary HIS-u-PA fusion proteins are set forth in SEQ ID NOs: 1017 and 1018. His tagged u-PA molecules optionally can contain a fusion partner, and/or a signal for expression and secretion. For example, the exemplary His-u-PA fusion protein set forth as SEQ ID NO: 1017 contains mouse immunoglobulin light chain kappa (κ) leader signal peptide sequence (SEQ ID NO: 999), 6×His (SEQ ID NO:989), SUMO (SEQ ID NO:1031), the u-PA protease domain (SEQ ID NO: 21), and HSA (SEQ ID NO:991). In another example, the exemplary His tagged-u-PA fusion protein set forth as SEQ ID NO: 1018 contains mouse immunoglobulin light chain kappa (κ) leader signal peptide sequence (SEQ ID NO: 999), 6×His (SEQ ID NO:989), SUMO (SEQ ID NO:1031), the u-PA protease domain (SEQ ID NO: 21), and Fc (SEQ ID NO:992).

(b) SUMO u-PA fusion proteins can include a His tag and/or SUMO sequences for accumulation in inclusion bodies. For example, the HIS-SUMO sequence set forth in SEQ ID NO: 990, and the u-PA protease domain, can be linked to the full-length modified u-PA polypeptide, or to a catalytically active portion thereof, such to the protease domain, or to a larger portion of the modified u-PA polypeptide. u-PA fusion polypeptides including His-SUMO tags and the u-PA protease domain were generated. Exemplary HIS-SUMO-u-PA proteins are set forth in SEQ ID NOs: 1017 and 1018. HIS-SUMO tagged u-PA molecules optionally can contain a fusion partner, and/or a signal for expression and secretion. For example, the His-SUMO-u-PA fusion protein set forth as SEQ ID NO: 1017 contains mouse immunoglobulin light chain kappa (κ) leader signal peptide sequence (SEQ ID NO: 999), 6×His (SEQ ID NO:989), SUMO (SEQ ID NO:1031), the u-PA protease domain (SEQ ID NO: 21), and HSA (SEQ ID NO:991). In another example, the exemplary His-SUMO-u-PA fusion protein set forth as SEQ ID NO: 1018 contains mouse immunoglobulin light chain kappa (κ) leader signal peptide sequence (SEQ ID NO: 999), 6×His (SEQ ID NO:989), SUMO (SEQ ID NO:1031), the u-PA protease domain (SEQ ID NO: 21), and Fc (SEQ ID NO:992).

7. Nucleic Acid Molecules

Nucleic acid molecules encoding u-PA polypeptides are provided herein. Nucleic acid molecules include allelic variants or splice variants of any encoded u-PA polypeptide, or catalytically active portion thereof. In one embodiment, nucleic acid molecules provided herein have at least 50, 55, 60, 65, 70, 75, 80, 85, 90, 91, 92, 93, 94, 95, 96, 97, 98 or 99% sequence identity to any nucleic acid encoded u-PA polypeptide or catalytically active portion thereof. In another embodiment, a nucleic acid molecule can include those with degenerate codon sequences of any of the u-PA polypeptides or catalytically active portions thereof such as those provided herein.

Nucleic acid molecules, or fusion proteins containing a catalytically active portion of a nucleic acid molecule, operably-linked to a promoter, such as an inducible promoter for expression in mammalian cells also are provided. Such promoters include, but are not limited to, CMV and SV40 promoters; adenovirus promoters, such as the E2 gene promoter, which is responsive to the HPV E7 oncoprotein; a PV promoter, such as the PBV p89 promoter that is responsive to the PV E2 protein; and other promoters that are activated by the HIV or PV or oncogenes.

A u-PA protease provided herein, also can be delivered to the cells in gene transfer vectors. The transfer vectors also can encode additional other therapeutic agent(s) for treatment of the disease or disorder, such as Rheumatoid Arthritis or cardiovascular disease or AMD or DGF, for which the protease is administered. Transfer vectors encoding a protease can be used systemically, by administering the nucleic acid to a subject. For example, the transfer vector can be a viral vector, such as an adenovirus vector. Vectors encoding a protease also can be incorporated into stem cells and such stem cells administered to a subject such as by transplanting or engrafting the stem cells at sites for therapy. For example, mesenchymal stem cells (MSCs) can be engineered to express a protease and such MSCs engrafted at a transplant site for therapy.

G. COMPOSITIONS, FORMULATIONS AND DOSAGES

Pharmaceutical compositions containing modified u-PA polypeptides, modified u-PA fusion proteins or encoding nucleic acid molecules, can be formulated in any conventional manner by mixing a selected amount of the polypeptide with one or more physiologically acceptable carriers or excipients. In most embodiments, the modified u-PA polypeptide or fusion protein will be in an activated form in the composition for administration. Thus, for example, the polypeptides will be two chain activated forms or, where the fusion protein contains a multimerization domain, the protein can be a multimer, such as a dimer.

Selection of the carrier or excipient is within the skill of the administering professional and can depend upon a number of parameters. These include, for example, the mode of administration (i.e., systemic, oral, nasal, pulmonary, local, topical or any other mode) and disorder treated. The pharmaceutical compositions provided herein can be formulated for single dosage (direct) administration or for dilution or other modification. The concentrations of the compounds in the formulations are effective for delivery of an amount, upon administration, that is effective for the intended treatment. Typically, the compositions are formulated for single dosage administration. To formulate a composition, the weight fraction of a compound or mixture thereof is dissolved, suspended, dispersed or otherwise mixed in a selected vehicle at an effective concentration such that the treated condition is relieved or ameliorated. Pharmaceutical carriers or vehicles suitable for administration of the compounds provided herein include any such carriers known to those skilled in the art to be suitable for the particular mode of administration.

1. Administration of Modified u-PA Polypeptides

For purposes of this section, modified u-PA polypeptides refer to u-PA polypeptides that contain modifications, such as the modified protease domains, and include the conjugates, such as fusion proteins. The polypeptides can be formulated as the sole pharmaceutically active ingredient in the composition or can be combined with other active ingredients. The polypeptides can be targeted for delivery, such as by conjugation to a targeting agent, such as an antibody. Liposomal suspensions, including tissue-targeted liposomes, also can be suitable as pharmaceutically acceptable carriers. These can be prepared according to methods known to those skilled in the art. For example, liposome formulations can be prepared as described in U.S. Pat. No. 4,522,811. Liposomal delivery also can include slow release formulations, including pharmaceutical matrices such as collagen gels and liposomes modified with fibronectin (see, for example, Weiner et al. (1985) *J Pharm Sci.* 74(9): 922-5).

The active compound is included in the pharmaceutically acceptable carrier in an amount sufficient to exert a therapeutically useful effect in the absence of undesirable side effects on the subject treated. The therapeutically effective concentration can be determined empirically by testing the compounds in known in vitro and in vivo systems, such as the assays provided herein.

The u-PA polypeptides provided herein (i.e. active compounds) can be administered in vitro, ex vivo, or in vivo by contacting a mixture, such as a body fluid or other tissue sample, with a u-PA polypeptide provided herein, including any of the modified u-PA polypeptides provided herein. For example, when administering a compound ex vivo, a body fluid, such as the vitreous, or tissue sample from a subject can be contacted with the u-PA polypeptides that are coated on a tube or filter, such as for example, a true or filter in a bypass machine. When administering in vivo, the active compounds can be administered by any appropriate route, for example, orally, nasally, pulmonary, parenterally, intravenously, intradermally, intravitreally, intraretinally, subretinally, periocularly, subcutaneously, or topically, in liquid, semi-liquid or solid form and are formulated in a manner suitable for each route of administration. Determination of dosage is within the skill of the physician, and can be a function of the particular disorder, route of administration and subject. Exemplary dosages, include for example 0.1-1 mg.

The modified u-PA polypeptide and physiologically acceptable salts and solvates can be formulated for administration by inhalation (either through the mouth or the nose), oral, transdermal, pulmonary, parenteral or rectal administration. For administration by inhalation, the modified u-PA polypeptide can be delivered in the form of an aerosol spray presentation from pressurized packs or a nebulizer with the use of a suitable propellant, e.g., dichlorodifluoromethane, trichlorofluoromethane, dichlorotetrafluoroethane, carbon dioxide or other suitable gas. In the case of a pressurized aerosol, the dosage unit can be determined by providing a valve to deliver a metered amount. Capsules and cartridges of, e.g., gelatin for use in an inhaler or insufflator, can be formulated containing a powder mix of a therapeutic compound and a suitable powder base such as lactose or starch.

For pulmonary administration to the lungs, the modified u-PA polypeptide can be delivered in the form of an aerosol spray presentation from a nebulizer, turbonebulizer, or microprocessor-controlled metered dose oral inhaler with the use of a suitable propellant. Generally, particle size of the aerosol is small, such as in the range of 0.5 to 5 microns. In the case of a pharmaceutical composition formulated for pulmonary administration, detergent surfactants are not typically used. Pulmonary drug delivery is a promising non-invasive method of systemic administration. The lungs represent an attractive route for drug delivery, mainly due to the high surface area for absorption, thin alveolar epithelium, extensive vascularization, lack of hepatic first-pass metabolism, and relatively low metabolic activity.

For oral administration, the pharmaceutical compositions can take the form of, for example, tablets, pills, liquid suspensions, or capsules prepared by conventional means with pharmaceutically acceptable excipients such as binding agents (e.g., pregelatinized maize starch, polyvinylpyrrolidone or hydroxypropyl methylcellulose); fillers (e.g., lactose, microcrystalline cellulose or calcium hydrogen phosphate); lubricants (e.g., magnesium stearate, talc or silica); disintegrants (e.g., potato starch or sodium starch glycolate); or wetting agents (e.g., sodium lauryl sulfate). The tablets can be coated by methods well known in the art. Liquid preparations for oral administration can take the form of, for example, solutions, syrups or suspensions, or they can be presented as a dry product for constitution with water or other suitable vehicle before use. Such liquid preparations can be prepared by conventional means with pharmaceutically acceptable additives such as suspending agents (e.g., sorbitol syrup, cellulose derivatives or hydrogenated edible fats); emulsifying agents (e.g., lecithin or acacia); non-aqueous vehicles (e.g., almond oil, oily esters, ethyl alcohol or fractionated vegetable oils); and preservatives (e.g., methyl or propyl-p-hydroxybenzoates or sorbic acid). The preparations also can contain buffer salts, flavoring, coloring and sweetening agents as appropriate.

Preparations for oral administration can be formulated for controlled release of the active compound. For buccal administration the compositions can take the form of tablets or lozenges formulated in conventional manner.

The modified u-PA polypeptides can be formulated as a depot preparation. Such long-acting formulations can be administered by implantation (for example, subcutaneously or intramuscularly) or by intramuscular injection. Thus, for example, the therapeutic compounds can be formulated with suitable polymeric or hydrophobic materials (for example, as an emulsion in an acceptable oil) or ion exchange resins, or as sparingly soluble derivatives, for example, as a sparingly soluble salt.

The modified u-PA polypeptide can be formulated for parenteral administration by injection (e.g., by bolus injection or continuous infusion). Formulations for injection can be presented in unit dosage form (e.g., in ampoules or in multi-dose containers) with an added preservative. The compositions can take such forms as suspensions, solutions or emulsions in oily or aqueous vehicles and can contain formulatory agents such as suspending, stabilizing and/or dispersing agents. Alternatively, the active ingredient can be in powder-lyophilized form for constitution with a suitable vehicle, e.g., sterile pyrogen-free water, before use.

The modified u-PA polypeptides can be formulated for ocular or ophthalmic delivery. Ocular drug delivery may be, for example, topical, oral or systemic, and/or injected. For example, a modified u-PA polypeptide(s) or pharmaceutical composition containing a modified u-PA polypeptide(s) may be administered topically, such as in the form of eye drops. In another example, a modified u-PA polypeptide(s) or pharmaceutical composition containing a modified u-PA polypeptide(s) can be administered by periocular and/or intravitreal or intraretinal or subretinal administration, such as, for example, by periocular, or intraretinal, or intravitreal injection(s).

The modified u-PA polypeptides or pharmaceutical composition containing modified u-PA polypeptides or nucleic acids encoding modified u-PA polypeptides can be formulated for systemic administration for treatment of DGF. In another example, the modified u-PA polypeptides or pharmaceutical composition containing modified u-PA polypeptides or nucleic acids encoding modified u-PA polypeptides are directly infused or injected into the kidney or into the tissues or organs adjacent or surrounding the transplanted kidney. The modified u-PA polypeptides or pharmaceutical composition containing modified u-PA polypeptides can be administered before the time of allograft transplantation or at the time of transplantation with administration continuing in a chronic fashion, and/or can be administered during a rejection episode in the event such an episode does occur.

The pharmaceutical compositions can be formulated for local or topical application, such as for topical application to the skin (transdermal) and mucous membranes, such as in the eye, in the form of gels, creams, and lotions and for application to the eye or for intracisternal or intraspinal application. Such solutions, particularly those intended for ophthalmic use, can be formulated as 0.01%-10% isotonic solutions and pH about 5-7 with appropriate salts. The compounds can be formulated as aerosols for topical application, such as by inhalation (see, for example, U.S. Pat. Nos. 4,044,126, 4,414,209 and 4,364,923, which describe aerosols for delivery of a steroid useful for treatment inflammatory diseases, particularly asthma).

The concentration of active compound in the drug composition depends on absorption, inactivation and excretion rates of the active compound, the dosage schedule, and amount administered as well as other factors known to those of skill in the art. As described further herein, dosages can be determined empirically using comparisons of properties and activities (e.g., cleavage of one or more complement proteins) of the modified u-PA polypeptide compared to the unmodified and/or wild type u-PA polypeptide.

The compositions, if desired, can be presented in a package, in a kit or dispenser device, that can contain one or more unit dosage forms containing the active ingredient. In some examples, the composition can be coated on a device, such as for example on a tube or filter in, for example, a bypass machine. The package, for example, contains metal or plastic foil, such as a blister pack. The pack or dispenser device can be accompanied by instructions for administration. The compositions containing the active agents can be packaged as articles of manufacture containing packaging material, an agent provided herein, and a label that indicates the disorder for which the agent is provided.

Also provided are compositions containing nucleic acid molecules, including expression vectors, encoding the u-PA polypeptides. In some embodiments, the compositions of nucleic acid molecules encoding the u-PA polypeptides and expression vectors encoding them are suitable for gene therapy. Rather than deliver the protein, nucleic acid can be administered in vivo, such as systemically or by other route, or ex vivo, such as by removal of cells, including lymphocytes, introduction of the nucleic acid therein, and reintroduction into the host or a compatible recipient.

2. Administration of Nucleic Acids Encoding Modified u-PA Polypeptides (Gene Therapy)

The modified u-PA polypeptides can be delivered to cells and tissues by expression of nucleic acid molecules. The modified u-PA polypeptides can be administered as nucleic acid molecules encoding the modified u-PA polypeptides, including ex vivo techniques and direct in vivo expression. Nucleic acids can be delivered to cells and tissues by any method known to those of skill in the art. The isolated nucleic acid can be incorporated into vectors for further manipulation. Methods for administering u-PA polypeptides by expression of encoding nucleic acid molecules include administration of recombinant vectors. The vector can be designed to remain episomal, such as by inclusion of an origin of replication or can be designed to integrate into a chromosome in the cell.

u-PA polypeptides also can be used in ex vivo gene expression therapy using vectors. Suitable gene therapy vectors and methods of delivery are known to those of skill in the art. For example, cells can be engineered to express a modified u-PA polypeptide, such as by integrating u-PA polypeptide encoding nucleic acid into a genomic location, either operatively linked to regulatory sequences or such that it is placed operatively linked to regulatory sequences in a genomic location. Such cells then can be administered locally or systemically to a subject, such as a patient in need of treatment. Exemplary vectors for in vivo and ex vivo gene therapy include viral vectors, and non-viral vectors such as, for example, liposomes or artificial chromosomes.

Viral vectors including, for example, adenoviruses, herpes viruses, adeno-associated viruses (AAV), retroviruses, such as lentiviruses, EBV, SV40, cytomegalovirus vectors, vaccinia virus vectors, and others designed for gene therapy can be employed. The vectors can be those that remain episomal or those that can integrate into chromosomes of the treated subject. A modified u-PA polypeptide can encoded in a viral vector, such as AAV, which is administered to a subject in need of treatment.

Virus vectors suitable for gene therapy include adenovirus, adeno-associated virus, retrovirus, lentivirus, and others noted above. For example, adenovirus expression technology is well-known in the art and adenovirus production and administration methods also are well known. Adenovirus serotypes are available, for example, from the American Type Culture Collection (ATCC®, Rockville, Md.). Adenovirus can be used ex vivo, for example, cells are isolated from a patient in need of treatment, and transduced with a modified u-PA polypeptide-expressing adenovirus vector. After a suitable culturing period, the transduced cells are administered to a subject, locally and/or systemically. Alternatively, u-PA polypeptide-expressing adenovirus particles are isolated and formulated in a pharmaceutically-acceptable carrier for delivery of a therapeutically effective amount to prevent, treat or ameliorate a disease or condition of a subject. In one embodiment, the disease to be treated is caused by complement activation. Typically, adenovirus particles are delivered at a dose ranging from 1 particle to $10^{14}$ particles per kilogram subject weight, generally between $10^6$ or $10^8$ particles to $10^{12}$ particles per kilogram subject weight.

The nucleic acid molecules can be introduced into artificial chromosomes and other non-viral vectors. Artificial chromosomes, such as ACES (see, Lindenbaum et al. Nucleic Acids Res. (2004) 32(21):e172) can be engineered to encode and express the u-PA polypeptide. Briefly, mammalian artificial chromosomes (MACs) provide a means to introduce large payloads of genetic information into the cell in an autonomously replicating, non-integrating format. Unique among MACs, the mammalian satellite DNA-based Artificial Chromosome Expression System (ACES) can be reproducibly generated de novo in cell lines of different species and readily purified from the host cells' chromosomes. Purified mammalian ACEs can then be re-introduced into a variety of recipient cell lines where they have been stably maintained for extended periods in the absence of selective pressure using an ACE System. Using this approach, specific loading of one or two gene targets has been achieved in LMTK(-) and CHO cells.

Another method for introducing nucleic acids encoding the modified u-PA polypeptides is a two-step gene replacement technique in yeast, starting with a complete adenovirus genome (Ad2; Ketner et al. (1994) Proc. Natl. Acad. Sci. USA 91: 6186-6190) cloned in a Yeast Artificial Chromosome (YAC) and a plasmid containing adenovirus sequences to target a specific region in the YAC clone, an expression cassette for the gene of interest and a positive and negative selectable marker. YACs are of particular interest because they permit incorporation of larger genes. This approach can be used for construction of adenovirus-based vectors bearing nucleic acids encoding any of the described modified u-PA polypeptides for gene transfer to mammalian cells or whole animals.

The nucleic acids can be encapsulated in a vehicle, such as a liposome, or introduced into a cell, such as a bacterial cell, particularly an attenuated bacterium or introduced into a viral vector. For example, when liposomes are employed, proteins that bind to a cell surface membrane protein associated with endocytosis can be used for targeting and/or to facilitate uptake, e.g., capsid proteins or fragments thereof tropic for a particular cell type, antibodies for proteins which undergo internalization in cycling, and proteins that target intracellular localization and enhance intracellular half-life.

In some embodiments, it is desirable to provide a nucleic acid source with an agent that targets cells, such as an antibody specific for a cell surface membrane protein or a target cell, or a ligand for a receptor on a target cell. Polynucleotides and expression vectors provided herein can be made by any suitable method. Further provided are nucleic acid vectors containing nucleic acid molecules as described above. Further provided are nucleic acid vectors containing nucleic acid molecules as described above and cells containing these vectors.

For ex vivo and in vivo methods, nucleic acid molecules encoding the u-PA polypeptide are introduced into cells that are from a suitable donor or the subject to be treated. Cells into which a nucleic acid can be introduced for purposes of therapy include, for example, any desired, available cell type appropriate for the disease or condition to be treated including, but not limited to, epithelial cells, endothelial cells, keratinocytes, fibroblasts, muscle cells, hepatocytes; blood cells such as T lymphocytes, B lymphocytes, monocytes, macrophages, neutrophils, eosinophils, megakaryocytes, granulocytes; various stem or progenitor cells, including hematopoietic stem or progenitor cells, e.g., such as stem cells obtained from bone marrow, umbilical cord blood, peripheral blood, fetal liver, and other sources thereof.

For ex vivo treatment, cells from a donor compatible with the subject to be treated or cells from a subject to be treated are removed, the nucleic acid is introduced into these isolated cells and the modified cells are administered to the subject. Treatment includes direct administration, such as, for example, encapsulated within porous membranes, which are implanted into the patient (see, e.g., U.S. Pat. Nos. 4,892,538 and 5,283,187). Techniques suitable for the transfer of nucleic acid into mammalian cells in vitro include the use of liposomes and cationic lipids (e.g., DOTMA, DOPE and DC-Chol) electroporation, microinjection, cell fusion, DEAE-dextran, and calcium phosphate precipitation methods. Methods of DNA delivery can be used to express u-PA polypeptides in vivo. Such methods include liposome delivery of nucleic acids and naked DNA delivery, including local and systemic delivery such as using electroporation, ultrasound and calcium-phosphate delivery. Other techniques include microinjection, cell fusion, chromosome-mediated gene transfer, microcell-mediated gene transfer and spheroplast fusion.

In vivo expression of a modified u-PA polypeptide can be linked to expression of additional molecules. For example, expression of a u-PA polypeptide can be linked with expression of a cytotoxic product such as in an engineered virus or expressed in a cytotoxic virus. Such viruses can be targeted to a particular cell type that is a target for a therapeutic effect. The expressed u-PA polypeptide can be used to enhance the cytotoxicity of the virus.

In vivo expression of a u-PA polypeptide can include operatively linking a u-PA polypeptide encoding nucleic acid molecule to specific regulatory sequences such as a cell-specific or tissue-specific promoter. u-PA polypeptides also can be expressed from vectors that specifically infect and/or replicate in target cell types and/or tissues. Inducible promoters can be used to selectively regulate u-PA polypeptide expression.

Nucleic acid molecules, as naked nucleic acids or in vectors, artificial chromosomes, liposomes and other vehicles can be administered to the subject by systemic administration, topical, local and other routes of administration. When systemic and in vivo, the nucleic acid molecule or vehicle containing the nucleic acid molecule can be targeted to a cell.

Administration also can be direct, such as by administration of a vector or cells that typically targets a cell or tissue. For example, tumor cells and proliferating cells can be targeted cells for in vivo expression of u-PA polypeptides. Cells used for in vivo expression of a u-PA polypeptide also include cells autologous to the patient. Such cells can be removed from a patient, nucleic acids for expression of a u-PA polypeptide introduced, and then administered to a patient such as by injection or engraftment.

Administration for Treatment of AMD and Other Ocular Diseases

Nucleic acids encoding the modified u-PA polypeptides provided can be administered for treatment of diseases or conditions involving complement activation in their etiology, in which inhibition thereof can ameliorate a symptom of the disease or condition or otherwise treat the disease or condition. Nucleic acids, such as vectors, such as viral vectors, designed for delivery of nucleic acids that encode the modified u-PA polypeptides described herein can be administered to subjects by any suitable route or a combination of different routes, depending upon the disease or condition. Nucleic acid delivery can be effected via direct delivery to the eye (such as via ocular delivery, subretinal injection, intravitreal (IVT) injection, intraretinal injection, or topical (e.g., eye drops) delivery), or delivery via systemic routes, e.g., intraarterial, intraocular, intravenous, intramuscular, subcutaneous, intradermal, and other parenteral routes of administration.

One skilled in the art can select any mode of administration compatible with the subject and virus for administration, and that also is likely to result in the virus reaching and entering the target cell-type or tissue, e.g., eye, such as retinal pigment epithelial (RPE) cells and/or photoreceptor cells. The route of administration can be selected by one skilled in the art according to any of a variety of factors, including the nature of the disease, the properties of the target cell or tissue (e.g., cell type), and the particular virus to be administered. Administration can be selected where cells or tissue of interest are targeted, such as the eye, e.g., the retinal pigment epithelial (RPE) cells and/or photoreceptor cells or the subretinal space.

Nucleic acid encoding the modified u-PA polypeptides, such as viral expression vectors, can be delivered, for example, to the target cell which is characterized by the disease, such as an ocular disease, such as AMD. For example, the composition containing the virus can be delivered by subretinal injection, such as subretinal injection to the retinal pigment epithelium (RPE), photoreceptor cells or other ocular cells (e.g., retinal ganglion cells). In some examples, subretinal administration of a virus, such as any virus containing the nucleic acids described herein, requires the skilled physician to perform a vitrectomy (i.e., where a needle hole is created in the retina (retinomy) and fluid is injected, such as fluid containing a virus, such as any virus described herein). Subretinal injections can be effected via a transcorneal route, through the pupil and then passing through the lens, vitreous and retina. In other examples, subretinal injection can be performed by passing a needle or any other administration device through the sclera, entering the pars plana or limbus area, though the mid- or posterior vitreous and to the opposite side of the retina, into the subretinal space. In other examples, subretinal injection can be performed by passing a needle or any other administration device through the sclera and through the choroid and Bruch's membrane, avoiding the retina to achieve delivery to the RPE. Other appropriate routes for subretinal administration can be determined by the skilled artisan or physician or surgeon. In some examples, bleb formation signals successful administration.

In other examples, the composition containing nucleic acid encoding the modified u-PA polypeptide for expression in the eye can be delivered by intravitreal injection to ocular cells, such as administration to target vitreal cells and cells in the inner retina. In some examples, intravitreal injection is performed by passing a needle or any other administration device through the pars plana, though the mid- or posterior vitreous and to the opposite side of the retina. After intravitreal injection, the composition containing the virus can be delivered to infect ganglion cells. In other examples, the composition containing the virus delivered by intravitreal injection target inner nuclear layer cells. Efficacy of delivery depends on virus titer and serotype. In some examples, treatment comprises direct intravitreal injection combined with an intravitreal implantable device (i.e., bioerodible and nonbioerodible intravitreal implantable devices) to increase concentration of the administered agent to the back of the eye (Hwang et al. (2012) *J Korean Med Sci* 27:1580-85).

In other examples, the composition containing the nucleic acid encoding the modified u-PA polypeptide is injected via the palpebral vein to target ocular cells. In other examples, the virus is applied ex vivo (e.g., applied to excised RPE choroid or fetal retinal cells or retinal cells) for transplantation into the eye, such as, for example, as a retinal graft. In other examples, one of skill in the art, such as the skilled physician can select the appropriate route for administration of any virus containing the nucleic acids described herein. If desired, routes of administration can be combined.

In one example, the virus is administered locally, at the site where the target cells, e.g., diseased cells, are present, i.e., in the eye or the retina. Topical administration often is used in eye diseases of the anterior segment of the eye (Patel et al. (2013) *World J Pharmacol* 2:47-64).

In one example, a virus to be delivered intravitreally can be administered with a thin needle (27 to 30 G) through the pars plana inside the vitreous body. The skilled artisan will determine how far the needle shaft is inserted into the eye (e.g., insertion depth), the speed of administration (e.g., the pressure applied to the plunger), the angle of orientation of the bevel, and the angle between the shaft and the pars plana.

H. THERAPEUTIC USES AND METHODS OF TREATMENT

The modified u-PA polypeptides provided herein target complement protein C3 and permit modulation of complement-mediated diseases and disorders. Therapeutic proteases, such as the modified u-PA polypeptides provided herein, have many potential advantages over traditional therapeutic approaches. Chief among them is the ability to inactivate disease targets in a catalytic manner (i.e. a one to many stoichiometry). Thus, proteases can maintain effective regulation at concentrations significantly below the target concentration. Additional differentiating advantages include (1) irreversible inactivation; (2) low dosing; (3) decreased dosing frequency (4) small molecular size; (5) the ability to target post-translational modifications; (6) the ability to neutralize high target concentrations; and (7) the ability to target away from the active site. As a therapeutic, a protease must still exhibit the following characteristics: (1) access to the molecular target (extracellular), and (2) possess sufficiently stringent specificity for a target critical to a disease state. The modified u-PA polypeptides provided herein can be used in the treatment of complement-mediated diseases and disorders.

The skilled artisan understands the role of the complement system in disease processes and is aware of a variety of such diseases. Provided is a brief discussion of exemplary diseases and the role of the complement protein C3 in their etiology and pathology. The modified u-PA polypeptides and nucleic acid molecules provided herein can be used for treatment of any condition for which activation of the complement pathway is implicated, particularly inflammatory conditions including acute inflammatory conditions, such as septic shock, and chronic inflammatory conditions, such as Rheumatoid Arthritis (RA). Acute and inflammatory conditions can be manifested as an immune-mediated disease such as, for example, autoimmune disease or tissue injury caused by immune-complex-mediated inflammation. A complement-mediated inflammatory condition also can be manifested as a neurodegenerative or cardiovascular disease that have inflammatory components. This section provides exemplary uses of, and administration methods for, modified u-PA polypeptides provided herein. These described therapies are exemplary and do not limit the applications of the modified u-PA polypeptides provided herein. Such methods include, but are not limited to, methods of treatment of physiological and medical conditions described and listed below. Such methods include, but are not limited to, methods of treatment of age-related macular degeneration (AMD), geographic atrophy (GA), paroxysmal nocturnal hemoglobinuria (PNH), renal delayed graft function (DGF), sepsis, Rheumatoid arthritis (RA), membranoproliferative glomerulonephritis (MPGN), lupus erythematosus, Multiple Sclerosis (MS), Myasthenia gravis (MG), asthma, inflammatory bowel disease, respiratory distress syndrome, immune complex (IC)-mediated acute inflammatory tissue injury, multi-organ failure, Alzheimer's Disease (AD), Ischemia-reperfusion injuries caused by events or treatments such as myocardial infarct (MI), stroke, cardiopulmonary bypass (CPB) or coronary artery bypass graft, angioplasty, or hemodialysis, chronic obstructive pulmonary disease (COPD), idiopathic pulmonary fibrosis (IPF) and/or Guillain Barre syndrome.

Treatment of diseases and conditions with modified u-PA polypeptides provided herein can be effected by any suitable route of administration using suitable formulations as described herein including, but not limited to, subcutaneous injection, oral, intravitreal, intraretinal, subretinal, periocular and transdermal administration. If necessary, a particular dosage and duration and treatment protocol can be empirically determined or extrapolated. For example, exemplary doses of wild type u-PA polypeptides can be used as a starting point to determine appropriate dosages. Modified u-PA polypeptides that have more specificity and/or selectivity compared to a wild type u-PA polypeptide can be effective at reduced dosage amounts and or frequencies. Dosage levels can be determined based on a variety of factors, such as body weight of the individual, general health, age, the activity of the specific compound employed, sex, diet, time of administration, rate of excretion, drug combination, the severity and course of the disease, and the patient's disposition to the disease and the judgment of the treating physician. The amount of active ingredient that can be combined with the carrier materials to produce a single dosage form will vary depending upon the host treated and the particular mode of administration.

Upon improvement of a patient's condition, a maintenance dose of a compound or compositions can be administered, if necessary; and the dosage, the dosage form, or frequency of administration, or a combination thereof can be modified. In some cases, a subject can require intermittent treatment on a long-term basis upon any recurrence of disease symptoms.

1. Disease Mediated by Complement Activation

The complement cascade is a dual-edged sword, causing protection against bacterial and viral invasion by promoting phagocytosis and inflammation. Conversely, even when complement is functioning normally, it can contribute to the development of disease by promoting local inflammation and damage to tissues. Thus, pathological effects are mediated by the same mediators that are responsible for the protective roles of complement. For example, the anaphylactic and chemotactic peptide C5a drives inflammation by recruiting and activating neutrophils, C3a can cause pathological activation of other phagocytes, and the membrane attack complex can kill or injure cells. In one example, such as in many autoimmune diseases, complement produces tissue damage because it is activated under inappropriate circumstances such as by antibody to host tissues. In other situations, complement can be activated normally, such as by septicemia, but still contributes to disease progression, such as in respiratory distress syndrome. Pathologically, complement can cause substantial damage to blood vessels (vasculitis), kidney basement membrane and attached endothelial and epithelial cells (nephritis), joint synovium (arthritis), and erythrocytes (hemolysis) if it is not adequately controlled.

Complement has a role in immuno-pathogenesis of a number of disorders, including autoimmune diseases such as rheumatoid arthritis (see, e.g., Wang et al. (1995) *Proc. Natl. Acad. Sci. U.S.A.* 92:8955-8959; Moxley et al. (1987) *Arthritis & Rheumatism* 30:1097-1104), lupus erythematosus (Wang et al. (1996) *Proc. Natl. Acad. Sci. U.S.A.* 90:8563-8568; and Buyon et al. (1992) *Arthritis Rheum.* 35:1028-1037) and acute glomerulonephritis (Couser et al. (1995) *J Am Soc Nephrol.* 5:1888-1894). Other pathologies that involve activation of the complement system include sepsis (see, e.g., Stove et al. (1996) *Cin Diag Lab Immunol* 3:175-183; Hack et al. (1989) *Am. J. Med.* 86:20-26), respiratory distress syndrome (see, e.g., Zilow et al. (1990) *Clin. Exp. Immunol.* 79:151-157; and Stevens et al. (1986) *J. Clin. Invest.* 77:1812-1816), multiorgan failure (see, e.g., Hecke et al. (1997) *Shock* 7:74; and Heideman et al. (1984) *J. Trauma* 24:1038-1043), ischemia-reperfusion injury such as occurs in cardiovascular disease such as stroke or myocardial infarct (Austen W G et al. (2003) *Int J Immunopathol Pharm* 16(1):1-8), age-related macular degeneration (Bradley et al. *Eye* 25: 683-693 (2011); Gemenetzi et al. *Eye* 30: 1-14 (2016)) and renal delayed graft function (Danobeitia et al. [abstract]. *Am J Transplant.* 2013; 13 (suppl 5); Yu et al. (2016) *Am J Transplant* 16(9):2589-2597; Castallano et al. (2010) *Am J Pathol* 176(4):1648-1659). Some exemplary examples of complement-mediated diseases are described below.

a. Rheumatoid Arthritis

Rheumatoid arthritis (RA) is a chronic inflammatory illness. It is an autoimmune disease in which the immune system attacks normal tissue components as if they were invading pathogens. The inflammation associated with rheumatoid arthritis primarily attacks the linings of the joints. The membranes lining the blood vessels, heart, and lungs also can become inflamed. RA is characterized by activated B cells and plasma cells that are present in inflamed synovium, and in established disease lymphoid follicles and germinal centers. This results in high levels of local immunoglobulin production and the deposition of immune complexes, which can include IgG and IgM rheumatoid factors, in the synovium and in association with articular cartilage which can serve as initiators of the complement cascade. Elevated levels of complement components, such as C3a, C5a, and C5b-9 have been found within the inflamed rheumatoid joints. These complement components can exacerbate the inflammation associated with RA by inducing a variety of proinflammatory activities such as, for example, alterations in vascular permeability, leukocyte chemotaxis, and the activation and lysis of multiple cell types.

b. Sepsis

Sepsis is a disease caused by a serious infection, such as a bacterial infection, leading to a systemic inflammatory response. The bacterial cell wall component, lipopolysaccharide, is often associated with sepsis, although other bacterial, viral, and fungal infections can stimulate septic symptoms. Septic shock often results if the natural immune system of the body is unable to defend against an invading microorganism such that, for example, the pro-inflammatory consequences of the immune response is damaging to host tissues. The early stages of sepsis are characterized by excessive complement activation resulting in increased production of complement anaphylatoxins, such as C3a, C4a, and C5a which act to increase vascular permeability, stimulate superoxide production from neutrophils and stimulate histamine release. The actions of C5a can contribute to a productive immune response to a bacterial infection, but if left unregulated, C5a also can be severely damaging. In an *E. coli*-induced model of inflammation, blockade of C5a improved the outcome of septic animals by limiting C5a-mediated neutrophil activation that can lead to neutrophil-mediated tissue injury.

The continued impairment of the innate immune response to a bacterial infection often leads to chronic sepsis or septic shock, which can be life-threatening. In the late stage of sepsis, it is the "dormant" activity of neutrophils, as opposed to the hyperactivity that occurs in the early phases, that contributes to continued disease. In the late stage, the major functions of neutrophils including chemotaxis, respiratory burst activity, and ability for bacterial killing are reduced. Complement, and in particular C5a, also plays a role in the later stages of sepsis. Excessive production of C5a during sepsis is associated with the "deactivation" of blood neutrophils, a process that has been linked to C5a-induced downregulation of its own receptor, C5aR, on neutrophils (Guo et al. (2003) *FASEB J* 13:1889). The reduced levels of C5aR on neutrophils correlates with a diminished ability of blood neutrophils to bind C5a, impaired chemotactic responses, a loss of superoxide productions, and impaired bactericidal activity. C5aR levels, however, can begin to "recover" at later stages of sepsis and correlate with instances of beneficial disease outcome.

c. Multiple Sclerosis

Multiple sclerosis (MS) and its animal model experimental allergic encephalomyelitis (EAE) are inflammatory demyelinating diseases of the central nervous system (CNS). In MS, inflammation of nervous tissue causes the loss of myelin, a fatty material which acts as a sort of protective insulation for the nerve fibers in the brain and spinal cord. This demyelination leaves multiple areas of scar tissue (sclerosis) along the covering of the nerve cells, which disrupts the ability of the nerves to conduct electrical impulses to and from the brain, producing the various symptoms of MS. MS is mediated by activated lymphocytes, macrophages/microglia and the complement system. Complement activation can contribute to the pathogenesis of these diseases through its dual role: the ability of activated terminal complex C5b-9 to promote demyelination and the capacity of sublytic C5b-9 to protect oligodendrocytes (OLG) from apoptosis.

d. Alzheimer's Disease

Alzheimer's disease (AD) is characterized by tangles (abnormal paired helical filaments of the protein tau, which normally binds to microtubules) and plaques (extracellular deposits composed primarily of beta-amyloid protein) within the brain. Although the precise cause of AD is not entirely clear, chronic neuroinflammation in affected regions of AD brains suggests that proinflammatory mediators can play a role. The tangles and plaques within an AD brain are deposited with activated complement fragments, such as, for example, C4d and C3d. Likewise, dystrophic neurites in an AD brain can be immunostained for MAC, indicating autocatalytic attack of these neurites and concomitant neurite loss in AD. Activation of complement in AD occurs by an antibody-independent mechanism induced by aggregated amyloid-beta protein. Further, the complement cascade can be activated by the pentraxins, C-reactive protein (CRP), and amyloid P (AP) which are all upregulated in AD (McGeer et al., (2002) *Trends Mol Med* 8:519). The activation of complement in AD, marked by increases in complement mediators, is not adequately controlled by a compensatory upregulation of complement regulatory proteins such as, for example, CD59. Thus, the proinflammatory consequences of complement activation exacerbates AD progression and likely contributes to neurite destruction.

e. Ischemia-Reperfusion Injury

Ischemia-reperfusion injury is the injury sustained after an ischemic event and subsequent restoration of blood flow and results from the inflammatory response to a hypoxic insult. Ischemia-reperfusion damage can be acute as during cardiac surgery procedures, such as, for example, following open heart surgery or angioplasty, or chronic as with congestive heart failure or occlusive cardiovascular disease. Examples of injuries that can cause ischemia-reperfusion injury include myocardial infarct (MI) and stroke. The initiation of an inflammatory response is likely caused by the increase in tissue oxygen levels that occur with reperfusion and the concomitant accumulation of metabolites that can generate oxygen free radicals which are immunostimulatory. Ischemia-reperfusion injury is associated with a variety of events including severity of myocardial infarction, cerebral ischemic events, intestinal ischemia, and many aspects of vascular surgery, cardiac surgery, trauma, and transplantation. The injury is manifested by inflammatory events of the innate immune system, particularly activation of the complement system, in response to newly altered tissue as non-self. As such ischemia-reperfusion injury is characterized by tissue edema caused by increased vascular permeability, and an acute inflammatory cell infiltrate caused by influx of polymorphonuclear leukocytes.

Activation of the complement system plays a role in the inflammatory events of ischemia-reperfusion injury. The ischemia injury results in alterations of the cell membrane, affecting lipids, carbohydrates, or proteins of the external surface such that these exposed epitopes are altered and can act as neo-antigens (modified self antigens). Circulating IgM recognize and bind the neo-antigens to form immune complexes on the injured cell surface. The antigen-antibody complexes formed are classic activators of the classical pathway of complement, although all pathways are likely involved in some way to the exacerbating effects of the injury. The involvement of the classical pathway of complement to ischemia-reperfusion injury is evidenced by mice genetically deficient in either C3 or C4 that display equal protection from local injury in a hindlimb and animal model of injury (Austen et al. (2003) *Int J Immunopath Pharm* 16:1). Conversely, in a kidney model of ischemia injury, C3-, C5-, and C6-deficient mice were protected whereas C4-deficient mice were not, suggesting the importance of the alternative complement pathway (Guo et al. (2005) *Ann Rev Immunol* 23:821). Mediators induced upon complement activation initiate an inflammatory response directed at the cell membrane at the site of local injury.

A major effector mechanism of complement in ischemia-reperfusion injury is the influx and activation of neutrophils to the inflamed tissue by complement components, such as for example C5a. Activation of neutrophils results in increased production of reactive oxygen species and the release of lysosomal enzymes in local injured organs which ultimately results in apoptosis, necrosis, and a loss or organ function. The generation of the terminal MAC, C5b-9, also contributes to local tissue injury in ischemia-reperfusion injury.

f. Ocular Disorders

In the normal eye, the complement system is continuously activated at low levels; membrane-bound and soluble intraocular complement regulatory proteins tightly regulate this spontaneous complement activation. Low level complement activation protects against pathogens without causing any damage to self-tissue and vision loss. The complement system and complement regulatory proteins control the intraocular inflammation in autoimmune uveitis and play an important role in the development of corneal inflammation, age-related macular degeneration and diabetic retinopathy. The complement system plays an important role in the pathogenesis of diabetic retinopathy (see, e.g., Ghosh et al. (2015) *Endocr Rev* 36:272-288) as well as diabetic neuropathy and diabetic cardiovascular disease. Spontaneous complement activation can cause damage to the corneal tissue after the infection. Complement inhibition is a relevant therapeutic target in the treatment of various ocular diseases (see, e.g., Purushottam et al. (2007) *Mol Immunol.* 44:3901-3908).

Age-Related Macular Degeneration (AMD)

Age-related macular degeneration is a clinical term that describes a variety of diseases that are characterized by the progressive loss of central vision. AMD is the leading cause of vision loss in aged individuals in many industrialized countries (Jager et al. (2008) *N Engl J Med* 358:2606-2617). Vision loss occurs due to the progressive degeneration of the macula, the region at the back of the eye comprising a high density of cone photoreceptors, which is specialized for high-acuity, central vision.

AMD can manifest as Dry (non-neovascular) AMD and/or Wet AMD. Dry AMD is the more common (85-90% of cases) and milder form of AMD, and is characterized by small, round, white-yellow lesions (drusen) in and under the macula. Advanced dry AMD, or geographic atrophy, leads to thinning of the retina due to loss of PRE photoreceptors, deterioration of the macula and eventual blindness. Although rarer, vision loss associated with wet AMD is generally more dramatic than in dry AMD. Wet AMD includes the formation of pathogenic blood vessels, termed choroidal neovascularization (CNV), in which abnormal blood vessels develop beneath the retinal pigment epithelium (RPE) layer of the retina. CNV invasion of the retina from the underlying choroid through fractures in Bruch membrane, the extracellular matrix between the choroid and the retinal pigment epithelium (RPE), or their breakage can cause vision loss in AMD (e.g., due to subretinal hemorrhage and/or scarring).

Early clinical hallmarks of AMD include thickening of the Bruch membrane and the appearance of drusen (Gass, J. D. (1972) *Trans. Am. Ophthalmol. Soc.* 70: 409-36), which are extracellular lipoproteinaceous deposits consisting of aggregated proteins (i.e., albumin, apolipoprotein E (APOE)), components of the complement pathway (e.g., complement factor H (CFH), C1q, C3, C5, C5b, C6, C7, C8, C9, and vitronectin (Hageman et al., (2001) *Prog. Retin. Eye. Res* 29:95-112; Hageman et al. (2005) *Proc. Nat. Acad. Sci.* 102: 7227-7232; Mullins et al. (2000) *FASEB H* 14:835-846; Anderson et al., (2010) *Pro. Retin. Eye Res.* 29:95-112)), immunoglobulins and/or amyloid-β (Crabb et al., (2002) *Proc Natl Acad Sci* 99: 14682-14687; Johnson et al., (2002) 99: 11830-11835)) and lipids and cellular components that are localized between the RPE and the Bruch membrane.

Inflammation in AMD is mediated by the deregulation of the alternative complement pathway. Complement components C3 and C5 are principal constituents of drusen in patients with AMD (Mullins et al., (2000) *FASEB J* 14, 835-46; Johnson et al., (2000) *Exp Eye Res* 70, 441-9; Anderson et al., (2002) *Am J Ophthalmol* 134, 411-31; and Leitner et al., (2001) *Exp Eye Res* 73, 887-96). It is hypothesized that drusen biogenesis involves chronic inflammatory processes that either can trigger complement activation and formation of MAC, which may lyse RPE cells or disturb physiological homeostasis in RPE cells, leading to inflammation characteristic of AMD (Johnson et al. (2001) *Exp Eye Res* 73, 887-896). Complement proteins (e.g., C3d) were also detected in blood in AMD patients (Scholl et al., (2008) *PLoS One* 3: e2593), indicating that AMD-induced inflammation may be systemic. There is genetic evidence for a role in complement in the pathogenesis of dry AMD (Klein et al. *Science* 308(5720):385-389 (2005); Yates et al., *NEJM* 357:553-561 (2007)), compstatin (and compstatin derivatives APL-1 and APL-2) and POT-4 (Potentia Pharmaceuticals), small peptide inhibitors of C3, may slow the progression of geographic atrophy (Ricklin et al. (2008) *Adv. Exp. Med. Biol.* 632: 273-292) in AMD, indicating that C3 (i.e., C3 inhibition) may be a viable target for AMD treatment.

g. Organ Transplantation and Delayed Graft Function (DGF)

Complement plays a role in the pathogenesis of ischemia-reperfusion injury. The mechanism of renal reperfusion injury depends on the generation of C5a and C5b-9, both of which have direct toxicity on the renal tubules contributing to acute tubular necrosis and apoptosis, and leading to post-ischemic acute renal failure and tissue fibrosis. In turn, the generation of these terminal pathway components depends on intra-renal synthesis of C3 and availability of other complement components that are essential for complement activation. The level of expression of C3 in the donor organ is strongly dependent on the cold ischemic time (Elham et al. (2010) *Curr Opin Organ Transplant.* 15:486-491).

Rejection in solid organ transplantation is influenced by the initial inflammatory response and subsequent adaptive alloimmune response, both of which are affected by various complement components. Complement proteins play a significant part in organ damage following transplantation in the process of ischemia reperfusion and in modulating the activation of the adaptive immune response. Inhibiting complement or modulating the function of complement protein molecules can reduce transplant organ damage and increase the organ lifespan (see, e.g., Elham et al. (2010) *Curr Opin Organ Transplant.* 15:486-491). Targeting complement components for therapeutic intervention can reduce organ damage at the time of organ recovery, transfer and after transplantation. Exemplary of such organs is the kidney. The modified u-PA polypeptides provided herein can be administered to mitigate and/or treat organ damage following transplantation.

Delayed graft function (DGF), such as renal delayed graft function, is a condition occurring in a subset of kidney transplant patients in which the transplanted organ fails to function normally immediately following transplant. Other possible transplants include, but are not limited to, heart, lung, vascular tissue, eye, cornea, lens, skin, bone marrow, muscle, connective tissue, gastrointestinal tissue, nervous tissue, bone, stem cells, islets, cartilage, hepatocytes, and hematopoietic cells. Renal DGF is characterized by acute necrosis of the renal allograft and is clinically defined by the need for dialysis shortly following transplantation. Acute kidney injury during the transplant process frequently manifests as DGF. The pathology underlying DGF is complex with contributions from donor-derived factors such as donor age and duration of ischemia, and recipient factors such as reperfusion injury, immunological responses and treatment with immunosuppressant medications.

Components of the complement cascade and complement activation play a critical role as mediators of transplant rejection and ischemia-reperfusion injury leading to DGF. Animal studies have established a key role for complement in ischemic reperfusion injury. For example, Eculizumab, a humanized monoclonal antibody directed against C5, blocks complement activation and was shown to prevent delayed graft function in a subset of high-risk kidney transplant patients (see, e.g., Horizon Scanning Research and Intelligence Centre brief, 2016 September; Johnson et al. (2015) *Curr Opin Organ Transplant* 20(6):643-651; Yu et al. (2016) *Am J Transplant* 16(9):2589-2597). Granular C4d deposition was associated with DGF in human renal allograft recipients (Kikić et al. (2014) *Transpl Int* 27(3):312-321). Increased C3 production is associated with kidney transplant rejection (Pratt et al. (2002) *Nat Med* 8(6):582-587; Damman et al. (2011) *Nephrol Dial Transplant* 26(7):2345-2354). Hence, the modified u-PA polypeptides provided herein, can be used as a therapeutic for preventing or ameliorating or eliminating transplant rejection and DGF.

2. Therapeutic Uses a. Immune-Mediated Inflammatory Diseases

Modified u-PA polypeptides described herein can be used to treat inflammatory diseases. Inflammatory diseases that can be treated with proteases include acute and chronic inflammatory diseases. Exemplary inflammatory diseases include central nervous system diseases (CNS), autoimmune diseases, airway hyper-responsiveness conditions such as in asthma, rheumatoid arthritis, inflammatory bowel disease, and immune complex (IC)-mediated acute inflammatory tissue injury.

Experimental autoimmune encephalomyelitis (EAE) can serve as a model for multiple sclerosis (MS) (Piddlesden et al., (1994) *J Immunol* 152:5477). EAE can be induced in a number of genetically susceptible species by immunization with myelin and myelin components such as myelin basic protein, proteolipid protein and myelin oligodendrocyte glycoprotein (MOG). For example, MOG-induced EAE recapitulates essential features of human MS including the chronic, relapsing clinical disease course the pathohistological triad of inflammation, reactive gliosis, and the formation of large confluent demyelinated plaques. Modified u-PA polypeptides can be assessed in EAE animal models. Modified u-PA polypeptides are administered, such as by daily intraperitoneal injection, and the course and progression of symptoms is monitored compared to control animals. The levels of inflammatory complement components that can exacerbate the disease also can be measured by assaying serum complement activity in a hemolytic assay and by assaying for the deposition of complement components, such as for example C1, C3 and C9.

Complement activation modulates inflammation in diseases such as rheumatoid arthritis (RA) (Wang et al., (1995) *Proc. Natl. Acad. Sci. U.S.A.* 92:8955). Modified u-PA polypeptides can be used to treat RA. For example, u-PA polypeptides can be injected locally or systemically. Modified u-PA polypeptides can be dosed daily or weekly. PEGylated u-PA polypeptides can be used to reduce immunogenicity. In one example, type II collagen-induced arthritis (CIA) can be induced in mice as a model of autoimmune inflammatory joint disease that is histologically similar to RA characterized by inflammatory synovitis, pannus formation, and erosion of cartilage and bone. To induce CIA, bovine type II collagen (B-CII) in the presence of complete Freund's adjuvant can be injected intradermally at the base of the tail. After 21 days, mice can be re-immunized using the identical protocol. To examine the effects of a u-PA polypeptide, 3 weeks following the initial challenge with B-CII, a u-PA polypeptide or control can be administered intraperitoneally twice weekly for 3 weeks. Mice can be sacrificed 7 weeks following the initial immunization for histologic analysis. To assess the therapeutic effect of a u-PA polypeptide on established disease, a u-PA polypeptide can be administered daily for a total of 10 days following the onset of clinical arthritis in one or more limbs. The degree of swelling in the initially affected joints can be monitored by measuring paw thickness using calipers. In both models, serum can be drawn from mice for hemolytic assays and measurement of complement markers of activation such as for example C5a and C5b-9. In another example, primate models are available for RA treatments. Response of tender and swollen joints can be monitored in subjects treated with u-PA polypeptides and controls to assess u-PA polypeptide treatment.

Modified u-PA polypeptide can be used to treat immune complex (IC)-mediated acute inflammatory tissue injury. IC-mediated injury is caused by a local inflammatory response against IC deposition in a tissue. The ensuing inflammatory response is characterized by edema, neutrophilia, hemorrhage, and finally tissue necrosis. IC-mediated tissue injury can be studied in an in vivo Arthus (RPA)

reaction. Briefly, in the RPA reaction, an excess of antibody (such as for example rabbit IgG anti-chicken egg albumin) is injected into the skin of animals, such as for example rats or guinea pigs, that have previously been infused intravenously with the corresponding antigen (i.e. chicken egg albumin) (Szalai et al., (2000) *J Immunol* 164:463). Immediately before the initiation on an RPA reaction, a u-PA polypeptide, or a bolus control, can be administered at the same time as the corresponding antigen by an intravenous injection via the right femoral vein. Alternatively, a u-PA polypeptide can be administered during the initial hour of the RPA reaction, beginning immediately after injection of the antigen and just before dermal injection of the antibody. The effects of a u-PA polypeptide on the generation of complement-dependent IC-mediated tissue injury can be assessed at various times after initiation of RPA by collecting blood to determine the serum hemolytic activity, and by harvesting the infected area of the skin for quantitation of lesion size.

Therapeutic u-PA polypeptides, such as those described herein, can be used to treat sepsis and severe sepsis that can result in lethal shock. A model of complement-mediated lethal shock can be used to test the effects of a u-PA polypeptide as a therapeutic agent. In one such example, rats can be primed with a trace amount of lipopolysaccharide (LPS), followed by the administration of a monoclonal antibody against a membrane inhibitor of complement (anti-Crry) (Mizuno et al., (2002) *Int Arch Allergy Immunol* 127:55-62). A u-PA polypeptide or control can be administered at any time during the course of initiation of lethal shock such as before LPS priming, after LPS priming, or after anti-Crry administration and the rescue of rats from lethal shock can be assessed.

b. Neurodegenerative Disease

Complement activation exacerbates the progression of Alzheimer's disease (AD) and contributes to neurite loss in AD brains. Modified u-PA polypeptides described herein can be used to treat AD. Mouse models that mimic some of the neuropathological and behavioral features of AD can be used to assess the therapeutic effects of u-PA polypeptides. Examples of transgenic mouse models include introducing the human amyloid precursor protein (APP) or the presenilin 1 (PS1) protein with disease-producing mutations into mice under the control of an aggressive promoter. These mice develop characteristics of AD including increases in beta-amyloid plaques and dystrophic neurites. Double transgenic mice for APP and PS1 mutant proteins develop larger numbers of fibrillar beta-amyloid plaques and show activated glia and complement factors associated with the plaque. u-PA polypeptides can be administered, such as by daily intraperitoneal or intravenous injections, and the course and progression of symptoms is monitored compared to control animals.

c. Cardiovascular Disease

Modified u-PA polypeptides provided herein can be used to treat cardiovascular disease. u-PA polypeptides can be used in the treatment of cardiovascular diseases including ischemia reperfusion injury resulting from stroke, myocardial infarction, cardiopulmonary bypass, coronary artery bypass graft, angioplasty, or hemodialysis. u-PA polypeptides also can be used in the treatment of the inflammatory response associated with cardiopulmonary bypass that can contribute to tissue injury. Generally, a u-PA polypeptide can be administered prior to, concomitantly with, or subsequent to a treatment or event that induces a complement-mediated ischemia reperfusion injury. In one example, a u-PA polypeptide can be administered to a subject prior to the treatment of a subject by a complement-mediated, ischemic-injury inducing event, such as for example coronary artery bypass graft of angioplasty.

Effects of a u-PA polypeptide on treatment of ischemia reperfusion injury can be assessed in animal models of the injury. In one such model, myocardial ischemia is induced in rabbits that have had an incision made in their anterior pericardium by placing a 3-0 silk suture around the left anterior descending (LAD) coronary artery 5-8 mm from its origin and tightening the ligature so that the vessel becomes completely occluded (Buerke et al., (2001) *J Immunol* 167:5375). A u-PA polypeptide, such as for example a modified u-PA polypeptide, or a control vehicle such as saline, can be given intravenously in increasing doses as a bolus 55 minutes after the coronary occlusion (i.e. 5 minutes before reperfusion). Five minutes later (i.e. after a total of 60 minutes of ischemia) the LAD ligature can be untied and the ischemic myocardium can be reperfused for 3 hours. At the end of the reperfusion period, the ligature around the LAD is tightened. Effects of a u-PA polypeptide on ischemia injury can be analyzed by assessing effects on myocardial necrosis, plasma creatine kinase levels, and markers of neutrophil activation such as for example myeloperoxidase activity and superoxide radical release.

In another model of complement-mediated myocardial injury sustained upon perfusion of isolated mouse hearts with Krebs-Henseleit buffer containing 6% human plasma, treatment with modified u-PA polypeptides can be used to limit tissue damage to the heart. In such an example, the buffer used to perfuse the hearts can be supplemented with varying doses of modified u-PA polypeptides. The perfused hearts can be assayed for deposition of human C3 and C5b-9, coronary artery perfusion pressure, end-diastolic pressure, and heart rate.

Modified u-PA polypeptides provided herein can be used as therapeutics prior to or following Cardiopulmonary Bypass (CPB) or coronary artery bypass graft to inhibit the inflammatory immune response that often follows bypass and that can contribute to tissue injury. An in vitro recirculation of whole blood in an extracorporeal bypass circuit can be used to stimulate platelet and leukocyte changes and complement activation induced by CPB (Rinder et al. (1995) *J. Clin. Invest.* 96:1564). In such a model, addition of a u-PA polypeptide or control buffer, in varying doses, can be added to a transfer pack already containing blood from a healthy donor and porcine heparin, just prior to addition of the blood to the extracorporeal circuit. Blood samples can be drawn at 5, 15, 30, 45, 60, 75, and 90 minutes after recirculation and assayed for complement studies such as for example hemolytic assays and/or complement activation assays to measure for C5a, C3a, and/or sC5b-9. A pretreatment sample of blood drawn before its addition to the extracorporeal circuit can be used as a control. Flow cytometry of blood samples can be performed to determine levels of adhesion molecules on populations of circulating leukocytes (i.e. neutrophils) in the blood such as, for example, CD11b and P-selectin levels.

d. Age-Related Macular Degeneration (AMD)

Modified u-PA polypeptides described herein can be used to treat Age-Related Macular Degeneration (AMD). Age-Related Macular Degeneration (AMD) that can be treated with proteases include wet AMD, dry AMD and geographic atrophy.

Numerous animal models of AMD are available that mimic many of the characteristics of the human disorder (Pennesi et al. (2012) *Mol. Aspects Med.* 33(4):487-509)). Mutations in complement pathway genes were shown to increase or decrease susceptibility to AMD (Edwards et al.

(2005) *Science* 308(5720):421-424; Hageman et al. (2005) *Proc. Nat. Acad. Sci* 102(20): 7227-7232; Klein et al. (2005) *Science* 308(5720):385-389). For example, in complement factor H (CFH), which normally interacts with C3b, the single nucleotide polymorphism Y402H prevented binding of C3b with factor B, leading to inhibition of C3 formation. Y402H is associated with an increased risk of AMD in people and the mutation was previously identified in 43-59% of AMD patients (Haines et al. (2005) *Science* 308(5720): 419-421; Thakkinstian et. al. (2006) *Hum. Mol. Genet.* 15(18): 2784-2790; Zareparsi et al. (2005) *Am. J. Hum. Genet.* 77(1): 149-153).

Genetically modified mice that lack the ability to make CFH develop characteristics of AMD, including retinal abnormalities, decreased visual acuity and complement deposition (Coffey et al. (2007) *Proc. Nat. Acad. Sci.* 104: 16651-16656). Mutations in complement proteins Factor B (Montes et al. (2009) *Proc. Nat. Acad. Sci.* 106(11): 4366-4371), C2 (Gold et al. (2006) *Nat. Genet.* 38(4): 458-462), and C3 (Maller et al. (2007) *Nat. Genet.* 39(10): 1200-1201; Yates et al. (2007) *New Engl. J. Med* 357(6): 553-561) are associated with increased or decreased risk of developing AMD based on their impact on expression and/or activity of the various complement proteins (Reynolds et al. (2009) *Invest. Ophthalmol. Vis. Sci.* 50(12): 5818-5827).

Modified u-PA proteases, such as modified u-PA proteases provided herein, where an activity, such as substrate specificity or selectivity, of the u-PA protease for cleaving complement protein C3 is altered can be can be used as therapeutics. The modified u-PA polypeptides provided herein are administered, for example, by bi-monthly intravitreal or subretinally, or intraretinal injection, and the course and progression of symptoms is monitored compared to control animals or subjects. The levels of complement components that can exacerbate the disease also can be measured by assaying serum complement activity in a hemolytic assay and by assaying for the deposition of complement components, such as, for example, C1, C3 and C9.

Complement activation plays a role in disease progress in Age-Related Macular Degeneration (AMD) (see, e.g., Bradley et al., (2011) *Eye* 25:683-693; Gemenetzi et al. (2016) 30:1-14). Modified u-PA polypeptides can be used to treat AMD. For example, u-PA polypeptides or a pharmaceutical composition containing u-PA polypeptides, such as the modified u-PA polypeptides described herein, can be injected intravitreally, or intraretinally, or subretinally, or periocularly. Modified u-PA polypeptides can be dosed daily or weekly or less frequently, such as for example, monthly or less frequently, such as bi-monthly. For AMD, modified uPA polypeptides that are not further "modified" for extended duration in the eye (e.g., fusion proteins, PEGylation, etc.) monthly dosing is likely (bi-monthly dosing also is contemplated). After appropriate "modification", every 3 months (or less frequently) may be possible. The modified u-PA polypeptides can be modified, such as by PEGylation to reduce potential immunogenicity and/or to increase serum half-life. For AMD, modified u-PA polypeptides that are not further modified for extended duration in the eye (e.g., fusion proteins, PEGylation) monthly dosing or bi-monthly dosing is used. If modified, such as by PEGylation, dosing can be effected every 3 months or more.

e. Organ Transplant

Delayed Graft Function (DGF)

Modified u-PA polypeptides described herein can be used to treat Delayed Graft Function (DGF), including, such as, for example, DGF as a result of Ischemia-Reperfusion Injury in kidney transplant recipients. u-PA polypeptides also can be used in the treatment of the inflammatory response associated with organ transplant that can contribute to tissue injury. Generally, a u-PA polypeptide can be administered prior to, concomitantly with, or subsequent to a treatment or event that induces a complement-mediated ischemia reperfusion injury. In one example, a u-PA polypeptide can be administered to a subject prior to the treatment of a subject by a complement-mediated, ischemic-injury inducing event, such as for example kidney transplant or kidney allograft. Effects of a u-PA polypeptide on treatment of delayed graft function, for example delayed graft function as a result of ischemia-reperfusion injury, can be assessed in animal models of the injury, which mimic characteristics displayed in human kidney allografts or transplants.

The presence of early biomarkers of early graft dysfunction leading to DGF, including biomarkers for tubular epithelial cell injury, may indicate the need for therapeutics. Biomarkers of DGF (i.e., serum creatine) have been identified (Malyszko et al. (2015) *Nature Scientific Reports* 5:11684; Wanga et al. (2015) PLoS One 10(9):e0136276). Early detection of biomarkers for DGF and therapeutic intervention, such as, for example, therapeutic treatment with a modified u-PA polypeptide, may improve clinical outcomes.

Complement activation modulates disease progress in disorders such as delayed graft function after organ transplant, for example kidney transplant (Yu et al. (2016) *Am J of Transplantation* 16(9):2589-2597). Modified u-PA polypeptides can be used to treat DGF. For example, u-PA polypeptides can be administered for systemic delivery or can be injected directly into the graft or the surrounding tissues. Modified u-PA polypeptides can be administered prior to, during or after transplant. Modified u-PA polypeptides can be dosed daily or weekly or less frequently, such as, for example, monthly or less frequently, such as bi-monthly. In some instances a single systemic dose of the modified u-PA polypeptide is administered. Multiple infusions of the modified u-PA polypeptide over several hours are also considered.

Modified u-PA polypeptides can be delivered chronically, if needed, for example, the modified u-PA polypeptides, such as the modified u-PA polypeptides described herein, can be delivered on a daily basis or on another schedule to maintain an effective amount in the allograft recipient. Modified u-PA polypeptides can be used to prolong allograft survival in a recipient, in particular, chronic survival of the allograft. PEGylated u-PA polypeptides can be used to reduce immunogenicity.

3. Combination Therapies u-PA polypeptides provided herein can be used in combination with other existing drugs and therapeutic agents to treat diseases and conditions. Such treatments can be performed in conjunction with other anti-inflammatory drugs and/or therapeutic agents. Examples of anti-inflammatory drugs and agents useful for combination therapies include non-steroidal anti-inflammatory drugs (NSAIDs) including salicylates, such as aspirin, traditional NSAIDs such as ibuprofen, naproxen, ketoprofen, nabumetone, piroxicam, diclofenac, or indomethacin, and Cox-2 selective inhibitors such as celecoxib (sold under the trademark Celebrex®) or Rotecoxin (sold under the trademark Vioxx®). Other compounds useful in combination therapies include antimetabolites such as methotrexate and leflunomide, corticosteroids or other steroids such as cortisone, dexamethasone, or prednisone, analgesics such as acetaminophen, aminosalicylates such as mesalamine, and cytotoxic agents such as azathioprine (sold under the trademark Imuran®), cyclophosphamide (sold under the trademark Cytoxan®), and cyclosporine A. Additional agents that can be used in combination therapies include biological response modifiers. Biological response modifiers can include pro-inflammatory cytokine inhibitors including inhibitors of TNF-alpha such as etanercept (sold under the trademark Enbrel®), infliximab (sold under the trademark Remicade®), or adalimumad (sold under the trademark Humira®), and inhibitors of IL-1 such as anakinra (sold under the trademark Kineret®). Biological response modifiers also can include anti-inflammatory cytokines such as IL-10, B cell targeting agents such as anti-CD20 antibodies (sold under the trademark Rituximab®), compounds targeting T antigens, adhesion molecule blockers, chemokines receptor antagonists, kinase inhibitors such as inhibitors to mitogen-activated protein (MAP) Kinase, c-Jun N-terminal Kinase (JNK), or nuclear factor (NF) κB (NFκB), and peroxisome proliferator-activated receptor-gamma (PPAR-γ) ligands. Additional agents that can be used in combination therapies include immunosuppressants. Immunosuppressants can include tacrolimus or FK-506; mycophenolic acid; calcineurin inhibitors (CNIs); CsA; sirolimus or other agents known to suppress the immune system.

u-PA polypeptides provided herein also can be used in combination with agents that are administered to treat cardiovascular disease and/or administered during procedures to treat cardiovascular disease such as for example those described herein that contribute to inflammatory conditions associated with complement-mediated ischemia-reperfusion injury. For example, u-PA polypeptides provided can be administered in combination with anti-coagulants. Examples of exemplary anti-coagulants include, but are not limited to, heparin, warfarin, acenocoumarol, phenindione, EDTA, citrate, oxalate, and direct thrombin inhibitors such as argatroban, lepirudin, bivalirudin, and ximelagatran.

u-PA polypeptides provided herein also can be used in combination with agents that are administered to treat DGF. u-PA polypeptides provided herein can, for example, be administered in combination with an immunosuppressive agent. Such combination is useful in prolonging allograft survival in a recipient, in particular, chronic survival of the allograft. In preferred embodiments, the combination is formulated and prepared such that it is suitable for chronic administration to the recipient of the allograft, for example, stable formulations are employed. In certain embodiments, the combination is formulated and prepared such that it is suitable for concurrent administration of the modified u-PA polypeptides and the immunosuppressive drug to the recipient of the allograft. In certain embodiments, the combination is formulated and prepared such that it is suitable for sequential (in either order) administration of the modified u-PA polypeptides and the immunosuppressive drug to the recipient of the allograft.

u-PA polypeptides provided herein also can be used in combination with other agents that are administered to treat macular degeneration. For example, modified u-PA polypeptides can be administered with any one or more of ranibizumab (sold under the trade name Lucentis™); bevacizumab (sold under the trade name Avastin™); pegaptanib sodium (sold under the trade name Macugen™); aflibercept (sold under the trade name Eylea™); and verteporfin (sold under the trade name Visudyne™). U-PA polypeptides and fusion proteins provided herein also can be used in combination with an implantable telescope, laser treatment or laser photocoagulation, surgery, and/or photodynamic therapy, alone or in combination with the therapeutic verteporfin, to treat macular degeneration.

Additional agents, such as other complement inhibitors, can be used as anti-inflammatory drugs in combination therapy with modified u-PA polypeptides as described herein. Examples of such other complement inhibitors include cobra venom factor (CVF), polyanionic molecules such as heparin, dextran sulphate, polyvinyl sulphate, polylysine, or suramin, natural molecules such as K-76COOH, Rosmarinic acid, or extract of the Chinese medicinal herb Ephedra, synthetic molecules such as afamastat mesilate (FUT-175), a synthetic inhibitor of C1s (C1s-INH-248), or an inhibitor against C1s and fD (BCX-1470), peptide inhibitors such as compstatin, antibody inhibitors of complement such as anti-C5 (N19-8), a humanized anti-C5 (h5G1.1), anti-C6, or anti-C8 antibodies, and soluble forms of membrane complement regulators such as soluble CR1 (sCR1), soluble DAF (sDAF), soluble MCP (sMCF), or soluble CD59 (sCD59) (Morgan et al., (2003) *Mol Immunol.* 40:159).

Pharmaceutical compositions containing u-PA polypeptides described herein can be used to treat any one or more inflammatory diseases or conditions mediated by complement activation. Also provided are combinations of u-PA polypeptides and another treatment or compound for treatment of an inflammatory disease or condition. The u-PA polypeptides and the anti-inflammatory agent can be packaged as separate compositions for administration together or sequentially or intermittently. Alternatively, they can provided as a single composition for administration or as two compositions for administration as a single composition. The combinations can be packaged as kits, optionally with additional reagents, instructions for use, vials and other containers, syringes and other items for use of the modified u-PA polypeptides.

I. EXAMPLES

The following examples are included for illustrative purposes only and are not intended to limit the scope of the invention.

Example 1

Cloning and Expression of Modified u-PA Polypeptides and Screening for Modified u-PA Polypeptides that Cleave C3 at the QHAR/AS Site A. Cloning of the u-PA Nucleic acid encoding amino acids 179-431 with the C122S mutation by chymotrypsin numbering (set forth in SEQ ID NO:5) of the human u-PA polypeptide (Uniprot P00749; set forth in SEQ ID NO:1) was cloned into the pE-SUMO-AMP expression vector C-terminal to the small ubiquitin-like modifier (SUMO) tag. The construct included the signal peptide (amino acids 1-20) and the protease domain (amino acids 179-431).

B. Generation of Modified u-PA Polypeptides

Modified u-PA polypeptides were generated by Quikchange site directed mutagenesis (Stratagene) according to the manufacturer's instructions with specifically designed oligonucleotides that served as primers to incorporate designed mutations into the newly synthesized DNA. A PCR reaction was set up containing the wild type u-PA DNA as a template and oligonucleotide primers designed to contain the desired mutation(s). Following PCR, each reaction product was digested with DpnI to remove dam methylated parental strands of DNA. The DNA then was transformed into *E. coli* XL-1 Blue Supercompetent cells (Stratagene) and plated on selective agar containing 50 µg/ml carbenicillin. Plasmid DNA was isolated from selected clones, and sequenced to verify incorporation of the intended mutation(s) at the selected location(s) within the u-PA encoding DNA and the absence of any additional, undesired mutations.

C. Preparation of u-PA Polypeptides

1. Transformation

DNA encoding wild-type and each of the variant u-PA polypeptides was cloned into the pE-SUMO-AMP expression vector C-terminal to the small ubiquitin-like modifier (SUMO) tag and prodomain as detailed in Section A. above, and the resulting constructs were transformed into BL21 Gold (DE3) *E. coli* cells (Agilent Technologies, Catalog number: 230132). Approximately 50 µL of chemically competent BL21 Gold (DE3) cells were transformed with 0.5 µL of the appropriate plasmid DNA (typically containing 1 pg-50 ng of total DNA). Cells and DNA were incubated on ice for 30 minutes, cells were then heat shocked at 42° C. for 45 sec and further incubated on ice for 2 minutes. 450 µL of room temperature Terrific Broth (TB) media (VWR International, Catalog number 100219-866) was added to the mixture, and cells were incubated in the TB media for 1 hour with shaking at 240 rpm at 37° C. 20 µL of this transformation mixture was spread on a 2×YT medium+100 µg/mL carbenicillin plate from Teknova (Cat #: Y4420) and incubated overnight at 37° C.

2. Expression of u-PA Polypeptides

Cells containing DNA encoding a desired u-PA polypeptide (typically obtained from a single, "confirmed" colony from the transformation process described above) were grown in approximately 50 mL of medium prepared by combining 50 µL of Carbenicillin, 0.3 mL of 20% Lactose solution, 5 mL of phosphate buffer, and 45 mls of base Terrific Broth (TB) media (Teknova, Catalog number L0350). The cells and growth medium were rotated at 400 rpm in an Infors Multitron Shaker at 37° C. After 18 to 22 hours of growth, bacteria were pelleted by centrifugation at 7,000 rpm in a 50 ml Falcon centrifuge tube in a Beckman Sorval RC6 Plus Centrifuge with Fiberlite F13-14×50 cs centrifugation rotor (Thermo-Fisher) for 10 minutes at 4° C. After centrifugation, the supernatant was decanted.

The cell pellet from the 50 mL culture was resuspended in 10 ml of cell lysis buffer A (50 mM Tris, pH 8.0, 50 mM NaCl, 2 mM EDTA, 0.1 mg/mL Lysozyme). The cell pellet was resuspended in buffer A by shaking at 240 rpm for 1 hr at 37° C. The resulting mixture was subjected to centrifugation at 7,000 rpm for 15 minutes, and the supernatant was decanted. The resulting pellets were resuspended in 10 ml BugBuster® extraction reagent (Merck Millipore, NC9591474) containing 20 µL Benzonase™ (Millipore Sigma). Cells were resuspended by vortexing and shaking at 240 rpm for 1 hr at 37° C. Following shaking, the remaining insoluble material was pelleted by centrifugation at 10,000 rpm for 15 minutes at 4° C., and the supernatant was decanted. The resulting pellet was resuspended by homogenizing in 10 ml of Wash Buffer A [50 mM Tris (pH 8.0), 300 mM NaCl, and 1% Triton X-100] using a Power Gen 500 homogenizer (Fisher Scientific, 14-261-04P). This mixture, containing resuspended u-PA polypeptide inclusion bodies (IBs) was centrifuged at 10,000 rpm for 15 minutes at 4° C., and the supernatant was discarded. The new pellets were resuspended in 10 mL of Wash Buffer B (50 mM Tris (pH 8.0)) and homogenized repeatedly until the pellet was well dispersed. The resulting mixture was again centrifuged at 10,000 rpm for 15 minutes at 4° C., the supernatant was decanted, and the pellet was allowed to air dry for 10 to 15 minutes. This pellet of u-PA polypeptide inclusion bodies (IB) can be stored at −20° C. or used immediately for the unfolding and refolding described below.

3. Unfolding of uPA

The insoluble SUMO-u-PA polypeptide fusion protein inclusion bodies were dissolved and denatured in 5 mL of unfolding buffer [6M GuHCl, 50 mM Tris pH 8, (Teknova, Catalog number: G0380)]. Freshly prepared DTT was added to a final concentration of 10 mM on the day of the re-folding procedure. This IB solution was agitated at 240 rpm at 37° C. for at least 1 hour (typically 2 hours), or until the inclusion bodies were fully dissolved. The fully-dissolved IB solution is clear but can exhibit a brownish tint.

4. Refolding of u-PA

The 5 ml solution of unfolded u-PA polypeptide described above is split into two aliquots of 2.5 ml, and each aliquot is added to 200 ml of refolding buffer [1.5 M Arginine, 50 mM Tris pH 8.0, 150 mM NaCl, 5 mM GSH (L-Glutathione Reduced, Sigma-Aldrich), and 4.0 mM GSSG (L-Glutathione Oxidized, Sigma-Aldrich)]. This solution containing u-PA polypeptides in Refolding Buffer was incubated on a shaker at 150 rpm for 24 hours at room temperature to allow folding to take place.

The resulting protein solution was transferred to 12,000-14,000 Dalton molecular weight cutoff (MWCO) Spectra/Por® regenerated cellulose dialysis tubing (VWR) that was approximately 35 cm in length, and dialyzed in 25 mM Bis-Tris, pH 6.1. Samples were dialyzed at least overnight, and, more typically, for several days. Samples dialyzed for only one day were incubated at room temperature, and samples dialyzed for more than one day were incubated at 4° C. The optimal ratio of total dialysis buffer volume to total sample volume was at least 100. Lower ratios typically produced lower yields of properly folded u-PA polypeptide. Following dialysis, the protease samples were removed from the dialysis tubing and filtered using a 500 mL 0.22 µm flask (Millipore).

4. Column Purification of Zymogen

The protein solution was then purified using Sulfopropyl Sepharose Fast Flow (SPFF) system. The column was prepared by adding of 6 mL of SPFF Superflow slurry (GE Lifesciences) (with approximately 3 mL of resin) to each Econo Column (BioRad), and the storage solution was allowed to drain from the resin. 10 mL of 25 mM Bis-Tris pH 6.1, 1 M NaCl was then added to the column containing the resin, and the solution was allowed to flow through the column. Then, 10 mL of 25 mM Bis-Tris pH 6.1 was added to the column containing the resin, and the solution was allowed to pass through. The bottom of the column is capped and stored with the addition of 10 mL 25 mM Bis-Tris pH 6.1 buffer to equilibrate the resin.

The refolded and dialysed u-PA polypeptide sample solution was applied to the equilibrated SPFF column, followed by 10 ml of 25 mM Bis-Tris pH 6.1, 50 mM NaCl. The unactivated, u-PA polypeptide zymogen was then eluted with 4 ml of 25 mM Tris pH 7.5, 500 mM NaCl that was collected into a 50 mL Falcon tube. The sample was then diluted with 25 mM Tris pH 7.5 to a total volume of 12 ml.

5. Activation of u-PA zymogen

The 12 ml sample containing the purified u-PA polypeptide zymogen was diluted by addition of 12 ml of activation buffer (25 mM Tris pH 7.5, 20 mM Benzamidine). The u-PA polypeptide zymogen was then converted into the corresponding active u-PA protease with the SUMO Protease ubiquitin-like specific protease-1 (ULP-1) from *Saccharomyces cerevisiae*. "Activation" of the u-PA polypeptide zymogen was accomplished by adding 120 µg of ULP-1 to the purified zymogen, briefly swirling the solution and incubating the sample overnight at room temperature.

6. Purification of Activated u-PA Polypeptides

Active u-PA polypeptides were purified using ion exchange chromatography. Prior to chromatography, the sample was filtered with a 50 ml filter unit. A Vivapure Q spin column was pre-conditioned with 5 ml of 25 mM Tris pH 7.5, 1M NaCl and 10 ml of 25 mM Tris pH 7.5 followed by centrifugation at 500 g in a Sorvall Legend RT centrifuge for 5 minutes.

Each sample containing an activated u-PA polypeptide was loaded onto an individual Q-spin column in 19 mL batches and centrifuged at 500 g for 5 minutes for each run. The flow-through containing activated u-PA without SUMO tag and Zymogen was collected. The pH of the resultant u-PA sample was adjusted by adding 12 ml of 25 mM Citric Acid, pH=5.0 and 60 µL of 1M Citric Acid. The resulting protein solution was then loaded onto a pre-conditioned Vivapure S spin column. This column was preconditioned with 5 ml of 25 mM Tris pH 7.5, 1M NaCl and 10 mL of 25 mM Tris pH 7.5, followed by centrifuging the column at 500 g for 5 mins. Samples were loaded onto the S-column (HiTrap SP HP; GE Healthcare) in 19 ml batches and the column was centrifuged at 500 g for 5 mins. The flow through from this process was discarded. The column is then "washed" with 10 ml of 25 mM Sodium Citrate pH 5.0, 20 mM NaCl. After washing the column, the collection tube is replaced with a new tube that contains 7 ml of the dilution buffer 50 mM Sodium Citrate pH 5.0. u-PA polypeptide is then eluted from the column with 7 ml of 25 mM Sodium Phosphate pH 7.0, 250 mM NaCl. The elute, containing a u-PA polypeptide, is then concentrated and "buffer-exchanged" into citrate buffered saline (CBS; 20 mM Sodium Citrate pH 5.0, 50 mM NaCl) using an Amicon Ultra-15 Centrifugal Filter Unit to achieve a final concentration of ≥60 µM ($A_{280}$ of ≥2.6). Optical density of the solutions was measured using a Nanodrop device. The quality of the preparation was initially assessed by SDS-PAGE. Two µg of u-PA polypeptide sample in 1× Sample Buffer containing Bond-Breaker TCEP was loaded on each "lane" of a 12-well 4-12% PAGE NovexBis-Tris gel, and run in 1×MES Running Buffer at 200 V for 40 min. Proteins were "visualized" by staining the gel with Coomassie Blue followed by destaining. Fractions containing single bands migrating at approximately 25 kDa were snap-frozen in liquid nitrogen and stored at –80° C. until use. The quality of individual u-PA polypeptide samples was further assessed by activity assays and mass spectroscopy.

D. Selection and Identification of Modified u-PA Polypeptides that Cleave C3 to Inactivate it Modified u-PA polypeptides were identified by screening a library of modified u-PA polypeptides against a modified serpin (PAI-1) as described, for example in detail in U.S. Pat. No. 8,211,428 (see, also published US application Publication No. US-2014-0242062-A1). An inhibitory serpin, or fragment thereof, capable of forming a covalent acyl enzyme intermediate between the serpin and protease is used for screening. Generally, the serpin used is one that in vivo normally targets the protease. In the assay a serpin modified by replacement of its reactive site loop (RSL) to include the target sequence (i.e. the active site in C3) captures modified proteases that will cleave the target site to form stable complexes. The captured modified protease is then isolated/identified. For u-PA, PAI-1, PAI-2, PAI-3, particularly PAI-1 which is an inhibitor thereof, are cognate serpins. The serpin PAI-1 was modified by replacing the residues indicated below with QHARASHLG (residues 737-745 of C3, SEQ ID NO: 47), which is the active site of human C3. All modified u-PA polypeptides were selected so that they cleave within the active site of C3. In particular they cleave between R and A.

Q H A R ↓ A S H L

ATIII "bait" (BELOW) with inserted sequence QHARASHLG (corresponding to an inactivating cleavage site in C3 (residues 737-745 of SEQ ID NO: 47)):

```
                   10         20         30         40         50          60
CHHPPSYVAH LASDFGVRVF QQVAQASKDR NVVFSPYGVA SVLAMLQLTT GGETQQQIQA
        70         80         90        100        110        120
AMGFKIDDKG MAPALRHLYK ELMGPWNKDE ISTTDAIFVQ RDLKLVQGFM PHFFRLFRST
       130        140        150        160        170        180
VKQVDFSEVE RARFIINDWV KTHTKGMISH LLGTGAVDQL TRLVLVNALY FNGQWKTPFP
       190        200        210        220        230        240
DSSTHRRLFH KSDGSTVSVP MMAQTNKFNY TEFTTPDGHY YDILELPYHG DTLSMFIAAP
       250        260        270        280        290        300
YEKEVPLSAL TNILSAQLIS HWKGNMTRLP RLLVLPKFSL ETEVDLRKPL ENLGMTDMFR
       310        320        330        340        350        360
QFQADFTSLS DQEPLHVALA LQKVKIEVNE SGTVASSSTL RRQHARASHL EIIIDRPFLF
       370
VVRHNPTGTV LFMGQVMEP
```

The mutations in above modified PAI-1 are as follows:

| RCL | LRRQHARASRL | 341 | 350 |
|---|---|---|---|
| Mutation | V1C | 1 | 1 |
| Mutation | N150H | 150 | 150 |
| Mutation | K154T | 154 | 154 |
| Mutation | Q319L | 319 | 319 |
| Mutation | A340L | 340 | 340 |
| Mutation | V341R | 341 | 341 |
| Mutation | I342R | 342 | 342 |
| Mutation | V343Q | 343 | 343 |
| Mutation | S344H | 344 | 344 |
| Mutation | M347A | 347 | 347 |
| Mutation | A348S | 348 | 348 |
| Mutation | P349H | 349 | 349 |
| Mutation | E350L | 350 | 350 |
| Mutation | M354I | 354 | 354 |

Table 14, in Example 2 below, sets forth mutations, and provides SEQ IDs for exemplary protease domains of modified u-PA polypeptides that contain the mutations. Numbering is chymotrypsin numbering. The modified u-PA polypeptides were generated and selected to inactivate C3, with the mutations indicated. While the SEQ ID NOs. reference protease domains, it is understood that the mutations can be included in precursor, full-length and mature modified u-PA polypeptides. The C122S replacement, or other conserved replacement for S, is included to reduce aggregation; while advantageous, it is optional. For modified u-PA for use for gene therapy or for PEGylation, the C122S replacement is not included in the modified u-PA or in the encoding nucleic acid. C122 can serve as a site for conjugate of a pegylation moiety or other modification. When expressed in vivo, aggregation generally is not a concern. Also for which the active form is a two chain form linked by a disulfide bond, the free Cys at residue 122 generally is not modified to Ser so that it is available to form the disulfide bond.

Example 2

In Vitro Cleavage of Complement Protein C3

The activity of the modified u-PA polypeptides for inactivation cleavage of C3 was determined by measuring the amount of intact human C3 remaining after incubation of the substrate complement protein human C3 with various concentrations of each modified protease for 1 hour at 37° C. In accord with this assay, signal is generated in the presence of intact human C3, and is lost as the C3 is cleaved.

2 µM plasma purified human C3 (Complement Technologies; Tyler, Tex.) was incubated with the modified u-PA polypeptides (0-250 nM) for 1 hour at 37° C. in buffer containing 50 mM Tris, pH 8.0, 50 mM NaCl, and 0.01% Tween-20. The activity of the modified u-PA polypeptides was quenched by the addition of EGR-CMK (Haematologic Technologies, EGRCK-01) to a final concentration of 10 µM and the hC3/modified u-PA polypeptide mixture was allowed to stand for 30 minutes at ambient temperature.

Residual levels of undigested human C3 were quantified using an Amplified Luminescent Proximity Homogeneous Assay Screen (sold under the trademark AlphaScreen®; Perkin Elmer). α-mouse IgG-coated acceptor beads at 100 µg/mL (Perkin Elmer #6760606) were incubated with 5 nM mouse α-hC3a mAb (Abcam #ab11872-50) in 50 mM Tris, pH 8.0, 50 mM NaCl, 0.01% Tween-20 and 0.2% BSA to form the acceptor bead mixture. The acceptor bead mixture was shielded from light and placed on a rotating shaker for 30-60 minutes. The hC3/modified u-PA polypeptide reaction mixtures (prepared above) were diluted 1600-fold into 50 mM Tris, pH 8.0, 50 mM NaCl, 0.01% Tween-20, 0.2% BSA and 4 µL aliquots were placed in duplicate wells of a 384-well Optiplate (Perkin Elmer #6007299). 8 µL of a α-hC3 mAb/acceptor beads mixture was incubated with 8 µL of 25 nM biotinylated goat α-hC3 pAb (prepared using EZ-Link Sulfo-NHS-LC-Biotin kit from Thermo Scientific #21327 from the unbiotinylated version from Complement Technologies #A213). The plate was then shielded from light and incubated for 30 minutes at ambient temperature. After this time, 4 µL of 100 µg/mL streptavidin-coated donor beads (Perkin Elmer #6760606) were added to each well and incubated for 60 minutes, shielded from light. The alphascreen signal (Excitation=680 nm, Emission=570 nm) was then measured using an Envision 2104 Multilabel plate reader (Perkin Elmer). This signal (corresponding to the concentration of remaining hC3 ([hC3])) was plotted as a function of Alterase® concentration ([Alterase]) and the data were fitted to the four parameter equation below to determine the concentration of modified u-PA polypeptide (the Alterase® concentration) required to cleave through 50% of the available hC3 ($EC_{50}$), the Hill slope (Hill) as well as the maximum (Max) and minimum (Min) signals in the assay.

$$[hC3] = \text{Min} + \frac{\text{Max} - \text{Min}}{1 + \left(\frac{[Alterase]}{EC_{50}}\right)^{Hill}}$$

Cleavage of hC3 by the u-PA variant containing the mutations R35Q/H37Y/R37aE/V38E/T39Y/V41R/D60aP/Y60bQ/T97aI/L97bA/H99Q/C122S/Y149R (see, SEQ ID NO:21) was measured independently a total of 13 times, using 9 different lots of the protease. The average $EC_{50}$ value for this modified u-PA polypeptide was determined to be 19 nM (n=13, SD=2.2); in the experiment for which the results are reported in the Table 14 below, it was 24.5 nM.

About 600 modified u-PA polypeptides comprising a protease domain with the mutations set forth in Table 14. Results are set forth in Table 14 below. The majority of the tested modified u-PA polypeptides cleaved human complement protein C3 significantly more efficiently (i.e., lower $ED_{50}$) than the wild type u-PA protease domain containing the C122S replacement; many with an $ED_{50}$ below 100 nM. The polypeptides include the C122 replacement to prevent aggregation upon expression, for example, of the protease domain. In some embodiments, the modified u-PA polypeptide is full length that is activated to form a two chain activated polypeptide. For such embodiments, the modified u-PA protease domain does not include the C122 replacement (279 by mature numbering); the cysteine forms a disulfide bond (between 148C and 279C by mature numbering, with reference to SEQ ID NO:3)

Among the tested u-PA variants are those that were less potent than wild type u-PA, particularly those variants for which no cleavage (i.e., indicated as NA in Table 14 below) of hC3 was observed during the one hour assay. Other low activity variants cleaved less than 25% of the hC3 during the assay and were therefore not assigned an $ED_{50}$. Based on these results, the skilled person can select mutations that increase cleavage activity for C3.

TABLE 14

| SEQ ID NO* | Mutation String | ED50 (nM) |
|---|---|---|
| 749 | R35Y/H37S/R37aP/V38E/T39Y/V41R/D60aP/Y60bD/T97aI/L97bA/H99Q/C122S/Y151L | 0.92 |
| 678 | R35W/R36Q/H37S/V38P/T39Y/V41R/Y60bN/T97aE/L97bA/H99Q/C122S/Y149R/Y151L | 2.38 |
| 277 | F30Y/R35Y/R36H/H37K/V38E/T39F/Y40F/V41R/K82R/T97aI/L97bA/H99Q/K110aR/C122S/Y149R/M157K | 2.47 |
| 280 | F30Y/R35Y/R36H/H37K/V38E/T39F/Y40F/V41R/T97aI/L97bA/H99Q/C122S/Y149R/M157K/K179R | 2.49 |

TABLE 14-continued

| SEQ ID NO* | Mutation String | ED50 (nM) |
|---|---|---|
| 278 | F30Y/R35Y/R36H/H37K/V38E/T39F/Y40F/V41R/K92R/T97aI/L97bA/H99Q/C122S/Y149R/M157K | 3.04 |
| 614 | F30Y/R35V/R36H/H37G/V38E/T39W/Y40H/V41R/Y60bW/T97aI/L97bA/H99Q/C122S/Y149E/M157K | 3.47 |
| 279 | F30Y/R35Y/R36H/H37K/V38E/T39F/Y40F/V41R/K92S/T97aI/L97bA/H99Q/C122S/Y149R/M157K | 3.48 |
| 276 | F30Y/R35Y/R36H/H37K/V38E/T39F/Y40F/V41R/K61R/K62R/T97aI/L97bA/H99Q/C122S/Y149R/M157K | 3.51 |
| 281 | F30Y/R35Y/R36H/H37K/V38E/T39F/Y40F/V41R/T97aI/L97bA/H99Q/C122S/Y149R/M157K/K179S | 3.87 |
| 291 | R35W/H37P/R37aN/V38E/T39Y/V41R/D60aP/Y60bL/T97aI/L97bA/H99Q/C122S | 4.38 |
| 690 | F30Y/R35W/R36T/H37S/V38S/T39Y/Y40L/V41R/Y60bN/T97aE/L97bA/H99Q/C122S/Y149R/Y151L/M157R/Q192Y | 4.47 |
| 272 | F30Y/R35Y/R36H/H37K/V38E/T39F/Y40F/V41R/T97aI/L97bA/H99Q/C122S/M157K | 4.68 |
| 287 | F30Y/R35Y/R36H/H37K/V38E/T39F/Y40F/V41R/K61S/K62S/T97aI/L97bA/H99Q/C122S/Y149R/M157K | 4.75 |
| 751 | R35A/H37E/R37aG/V38E/T39Y/V41R/D60aP/Y60bD/T97aI/L97bA/H99Q/C122S/Y151L | 4.76 |
| 676 | R35W/R36Q/H37S/V38T/T39Y/Y40H/V41R/Y60bN/T97aE/L97bA/H99Q/C122S/Y149R/Y151P/M157R | 4.78 |
| 668 | F30Y/R35W/H37Y/V38E/T39Y/Y40H/V41R/Y60bN/T97aE/L97bA/H99Q/C122S/Y149R | 4.92 |
| 977 | V38E/T39W/V41R/D60aW/Y60bP/L97bG/H99L/C122S | 4.94 |
| 682 | R35W/R36K/H37S/V38E/T39Y/Y40L/V41R/Y60bN/T97aE/L97bA/H99Q/C122S/Y149R/Y151L/M157S/Q192H | 5.01 |
| 792 | R35Q/H37Y/R37aP/V38E/T39Y/V41R/D60aQ/Y60bP/T97aI/L97bA/H99Q/C122S/Y149R | 5.14 |
| 225 | I17V/F30Y/R35Q/R36H/H37W/V38E/Y40H/V41R/T97aI/L97bA/H99Q/C122S/M157K/T158A | 5.21 |
| 750 | R35Y/H37S/R37aP/V38E/T39Y/V41R/D60aP/Y60bD/T97aI/L97bA/H99Q/C122S/Y151L/Q192H | 5.26 |
| 10 | F30Y/R35W/R36H/H37D/V38E/T39Y/Y40F/V41R/T97aI/L97bA/H99Q/C122S/Y149R/M157K | 5.33 |
| 675 | R35W/R36N/H37S/V38E/T39Y/Y40M/V41R/Y60bN/T97aE/L97bA/H99Q/C122S/Y149R/M157S | 5.52 |
| 802 | R35Y/H37D/V38E/T39W/V41R/D60aP/Y60bE/T97aI/L97bA/H99Q/C122S/Y149R | 5.57 |
| 288 | F30Y/R35Y/R36H/H37K/V38E/T39F/Y40F/V41R/K82S/T97aI/L97bA/H99Q/K110aS/C122S/Y149R/M157K | 5.82 |
| 744 | R35W/H37P/R37aN/V38E/T39Y/V41R/D60aP/Y60bL/D97T/T97aE/L97bG/A98S/H99L/C122S | 6.17 |
| 275 | F30Y/R35Y/R36H/H37K/V38E/T39F/Y40F/V41R/T97aI/L97bA/H99Q/Y149R/M157K | 6.24 |
| 753 | R35Y/H37S/R37aP/V38E/T39Y/V41R/D60aP/Y60bD/T97aI/L97bA/H99Q/C122S | 6.24 |
| 669 | F30Y/R35W/H37S/V38E/T39Y/Y40H/V41R/Y60bN/T97aI/L97bA/H99Q/C122S/Y149R/M157K | 6.35 |
| 286 | F30Y/R35W/H37S/V38E/T39Y/Y40H/V41R/Y60bN/T97aE/L97bA/H99Q/C122S/M157K | 6.38 |
| 981 | R35H/V38E/T39Y/V41R/D60aP/Y60bQ/L97bA/H99Q/C122S/T158A | 7.23 |
| 656 | R35Q/R36H/H37Y/V38E/T39Y/Y40L/V41R/T97aI/L97bA/H99Q/C122S/Y149R/M157K | 7.33 |
| 705 | R35W/H37P/R37aG/V38E/T39Y/V41R/D60aP/Y60bE/T97aI/L97bA/H99Q/C122S/Y149R | 7.4 |
| 824 | V38D/V41Q/D60aH/Y60bS/T97aW/L97bR/H99E/C122S/Y151L/E175D/R217E/K224R | 7.48 |
| 731 | F30Y/R35W/R36H/H37P/R37aQ/V38E/T39Y/Y40F/V41R/Y60bQ/T97aE/L97bA/H99Q/C122S/Y149R/M157K | 7.52 |
| 677 | F30Y/R35W/R36Q/H37S/V38P/T39Y/Y40L/V41R/Y60bN/T97aE/L97bA/H99Q/C122S/Y149R/M157R | 7.55 |
| 679 | F30H/R35W/R36T/H37S/V38P/T39Y/V41R/Y60bN/T97aE/L97bA/H99Q/C122S/Y149R/Y151L/M157S | 7.59 |
| 613 | F30Y/R35W/R36H/H37D/V38E/T39Y/Y40H/V41R/Y60bD/T97aI/L97bA/H99Q/C122S/M157K | 7.64 |
| 707 | F30Y/R35Y/R36H/H37N/V38E/T39F/Y40F/V41R/K61E/R72H/T97aI/L97bA/H99Q/C122S/Y149R/M157K/Q169K | 7.64 |
| 688 | R35W/R36Q/H37S/V38S/T39Y/V41R/Y60bN/T97aE/L97bA/H99Q/C122S/Y149R/Y151L/M157S/Q192H | 8.04 |
| 752 | R35W/H37G/R37aE/V38E/T39Y/V41R/D60aP/Y60bD/T97aI/L97bA/H99Q/C122S/Y151L/Q192T | 8.07 |
| 19 | R35W/H37P/R37aN/V38E/T39Y/V41R/D60aP/Y60bL/T97aI/L97bA/H99Q/C122S/Y149R | 8.13 |
| 290 | F30Y/R35W/H37S/V38E/T39Y/Y40H/V41R/Y60bN/T97aE/L97bA/H99Q/C122S | 8.23 |
| 616 | F30Y/R35V/R36H/H37G/V38E/T39W/Y40H/V41R/Y60bA/T97aI/L97bA/H99Q/C122S/Y149R/M157K | 8.3 |
| 670 | F30Y/R35W/R36H/H37S/V38E/T39Y/Y40H/V41R/Y60bN/T97aE/L97bA/H99Q/C122S/Y149R | 8.44 |
| 285 | F30Y/R35W/H37S/V38E/T39Y/Y40H/V41R/Y60bN/T97aE/L97bA/H99Q/C122S/Y149R | 8.44 |
| 283 | F30Y/R35W/R36H/H37S/V38E/T39Y/Y40H/V41R/Y60bN/T97aE/L97bA/H99Q/C122S/M157K | 8.6 |

TABLE 14-continued

| SEQ ID NO* | Mutation String | ED50 (nM) |
|---|---|---|
| 284 | F30Y/R35W/R36H/H37S/V38E/T39Y/Y40H/V41R/Y60bN/T97aE/L97bA/H99Q/C122S | 8.78 |
| 683 | F30Y/R35W/R36S/H37S/V38Q/T39Y/Y40L/V41R/Y60bN/T97aE/L97bA/H99Q/C122S/Y149R/Y151L/M157S/Q192N | 8.86 |
| 727 | F30Y/R35W/R36H/H37P/R37aD/V38E/T39Y/Y40F/V41R/D60aE/Y60bS/T97aE/L97bA/H99Q/C122S/Y149R/M157K | 8.9 |
| 799 | R35Q/H37Y/R37aS/V38E/T39Y/V41R/D60aP/Y60bE/T97aI/L97bA/H99Q/C122S/Y149R | 8.95 |
| 949 | R37aS/V38E/Y40V/V41R/H99L/C122S/Y151L/R217V | 9.04 |
| 831 | V38D/V41R/L97bG/H99Q/C122S/Y151L/R217E | 9.09 |
| 33 | R35Q/H37Y/R37aE/V38E/T39Y/V41R/D60aP/Y60bQ/T97aI/L97bA/H99Q/C122S | 9.27 |
| 624 | F30Y/R35V/R36H/H37D/V38E/T39W/Y40H/V41R/Y60bP/T97aI/L97bA/H99Q/C122S/Y149R/M157K | 9.54 |
| 223 | I17V/F30Y/R35Q/R36H/H37W/V38E/Y40H/V41R/T97aI/L97bA/H99Q/C122S/M157K | 9.65 |
| 617 | F30Y/R35V/R36H/H37S/V38E/T39F/Y40H/V41R/Y60bS/T97aM/L97bA/H99Q/C122S/Y149W/M157K | 10.2 |
| 703 | R35Y/H37S/R37aP/V38E/T39Y/V41R/D60aP/Y60bD/T97aI/L97bA/H99Q/C122S/Y149R | 10.3 |
| 706 | N26D/F30Y/R35Y/R36H/H37E/V38E/T39F/Y40F/V41R/K61E/T97aI/L97bA/H99Q/R110dS/P114S/C122S/Y149R/M157K | 10.3 |
| 732 | F30Y/R35W/R36H/H37P/R37aE/V38E/T39Y/Y40F/V41R/Y60bA/T97aE/L97bA/H99Q/C122S/Y149R/M157K | 10.3 |
| 796 | R35L/H37D/R37aN/V38E/T39Y/V41R/D60aP/T97aI/L97bA/H99Q/C122S/Y149R | 10.4 |
| 14 | F30Y/R35W/R36H/H37P/V38E/T39Y/Y40F/V41R/Y60bS/T97aE/L97bA/H99Q/C122S/Y149K/M157K | 10.6 |
| 29 | R35Q/H37Y/R37aE/V38E/T39Y/V41R/D60aP/T97aI/L97bA/H99Q/C122S/Y149R | 10.6 |
| 979 | R35H/V38E/T39Y/V41R/D60aP/Y60bQ/L97bA/H99Q/C122S/T158S/E167K | 10.6 |
| 24 | R35Q/H37Y/V38E/T39Y/V41R/D60aP/Y60bQ/T97aI/L97bA/H99Q/C122S/Y149R | 10.7 |
| 633 | F30Y/R35Y/R36H/H37D/V38E/T39W/Y40H/V41R/Y60bE/T97aI/L97bA/H99Q/C122S/Y149R/M157K | 10.8 |
| 12 | F30Y/R35Y/R36H/H37K/V38E/T39F/Y40F/V41R/T97aI/L97bA/H99Q/C122S/Y149R/M157K | 10.8 |
| 708 | F30Y/R35Y/R36H/H37E/V38E/T39F/Y40F/V41R/K61E/T97aI/L97bA/H99Q/C122S/Y149R/M157K/T242A | 11.1 |
| 557 | F30Y/R35L/V38D/Y40H/V41R/L97bA/H99Q/C122S/M157K/T158A | 11.3 |
| 724 | F30Y/R35Y/R36H/H37P/R37aQ/V38E/T39Y/Y40F/V41R/Y60bH/T97aE/L97bA/H99Q/C122S/Y149R/M157K | 11.3 |
| 882 | V38D/V41R/L97bR/H99E/C122S/Y151L/R217E | 11.4 |
| 335 | H37G/R37aD/G37bD/V38F/T39H/V41R/Y60bK/T97aS/L97bR/H99E/C122S/Y151L/E175D/R217E/K224R | 11.5 |
| 746 | R35Y/H37V/R37aW/V38E/T39Y/V41R/D60aP/Y60bE/T97aI/L97bA/H99Q/C122S/Y151L/Q192T | 11.6 |
| 615 | F30Y/R35M/R36H/H37G/V38E/T39F/Y40H/V41R/Y60bP/T97aF/L97bA/H99Q/C122S/Y149R/M157K | 11.7 |
| 684 | F30Y/R35W/R36Q/H37S/V38T/T39Y/Y40L/V41R/Y60bN/T97aE/L97bA/H99Q/C122S/Y149R/Y151L/M157K/Q192T | 11.8 |
| 701 | R35W/H37D/R37aP/V38E/T39W/V41R/D60aR/Y60bS/T97aI/L97bA/H99Q/C122S/Y149R | 11.8 |
| 260 | I17V/F30Y/R35W/R36H/H37E/V38E/T39W/Y40H/V41R/Y60bQ/T97aE/L97bA/H99Q/C122S/Y149K/M157K | 11.9 |
| 218 | I17V/F30Y/R35Q/H37W/V38D/Y40H/V41R/Y60bN/L97bA/H99Q/C122S/Y149H/M157K/T158A | 12 |
| 978 | R35H/V38E/T39Y/V41R/D60aP/Y60bQ/L97bA/H99Q/C122S/I138V/E167K | 12.1 |
| 680 | F30Y/R35W/R36Q/H37S/V38E/T39Y/Y40L/V41R/Y60bN/T97aE/L97bA/H99Q/C122S/Y149R/Y151L/M157T/Q192H | 12.4 |
| 980 | R35H/G37bD/V38E/T39Y/V41R/D60aP/Y60bQ/L97bA/H99Q/C122S/T158S | 12.4 |
| 794 | R35H/H37P/R37aG/V38E/T39F/V41R/D60aP/Y60bE/T97aI/L97bA/H99Q/C122S/Y149R | 12.6 |
| 611 | F30Y/R35W/R36H/H37S/V38E/T39Y/Y40H/V41R/Y60bN/T97aE/L97bA/H99Q/C122S/Y149R/M157K | 12.7 |
| 926 | V38D/T39Y/Y40L/V41R/L97bI/H99E/C122S/R217E | 12.8 |
| 224 | F30Y/R36H/V38E/Y40H/V41R/T97aI/L97bA/H99Q/C122S/M157K/T158A | 12.9 |
| 689 | F30H/R35W/R36H/H37S/V38E/T39Y/Y40M/V41R/Y60bN/T97aE/L97bA/H99Q/C122S/Y149R/M157K | 13 |
| 650 | R35V/R36H/H37D/V38E/T39W/Y40M/V41R/T97aI/L97bA/H99Q/C122S/Y149R/M157K | 13.1 |
| 685 | R35W/R36K/H37S/V38A/T39Y/V41R/Y60bN/T97aE/L97bA/H99Q/C122S/Y149R/Y151L/M157R/Q192T | 13.3 |
| 628 | F30Y/R35W/R36H/H37D/V38E/T39Y/Y40H/V41R/Y60bA/T97aI/L97bA/H99Q/C122S/Y149R/M157K | 13.5 |
| 717 | F30Y/R35W/R36H/H37S/V38E/T39Y/Y40F/V41R/Y60bN/T97aE/L97bA/H99Q/C122S/N145S/S146V/T147M/D148G/Y149Q/L150F/M157K | 13.6 |
| 275 | F30Y/R35Y/R36H/H37K/V38E/T39F/Y40F/V41R/T97aI/L97bA/H99Q/Y149R/M157K | 13.7 |
| 658 | F30Y/R35I/R36H/H37D/V38E/T39F/Y40F/V41R/T97aI/L97bA/H99Q/C122S/Y149R/M157K | 14.1 |
| 373 | R35V/V38E/Y40Q/V41L/Y60bS/T97aE/L97bA/H99Q/C122S/Y149R | 14.4 |
| 800 | R35Q/H37Y/R37aP/V38E/T39Y/V41R/D60aN/Y60bN/T97aI/L97bA/H99Q/C122S/Y149R | 14.5 |

TABLE 14-continued

| SEQ ID NO* | Mutation String | ED50 (nM) |
|---|---|---|
| 957 | V38E/Y40Q/V41L/L97bG/H99Q/C122S/R217T | 14.5 |
| 983 | R35H/V38E/T39Y/V41R/T56S/D60aP/Y60bQ/L97bA/H99Q/C122S/T158S | 14.6 |
| 513 | F30H/R35Q/H37W/V38D/V41R/L97bA/H99Q/C122S/Y151L/M157K | 14.7 |
| 300 | R35Q/H37Y/V38E/T39Y/V41R/D60aP/T97aI/L97bA/H99Q/C122S/Y149R | 14.7 |
| 745 | R35W/H37P/R37aN/V38E/T39Y/V41K/D60aP/Y60bD/T97aI/L97bA/H99Q/C122S/Y151L/Q192A | 14.8 |
| 821 | V38D/V41R/Y60bR/T97aW/L97bR/H99E/C122S/E175D/R217E/K224R | 14.8 |
| 674 | F30Y/R35W/R36H/H37S/V38E/Y40H/Y60bN/T97aI/L97bA/H99Q/C122S/Y149R | 15.1 |
| 823 | V38D/V41L/Y60bP/T97aM/L97bR/H99E/C122S/Y151L/E175D/R217E/K224R | 15.3 |
| 627 | F30Y/R35W/R36H/H37D/V38E/T39F/Y40H/V41R/Y60bE/T97aI/L97bA/H99Q/C122S/Y149R/M157K | 15.4 |
| 13 | F30Y/R35W/R36H/H37N/V38E/T39Y/Y40F/V41R/Y60bS/T97aE/L97bA/H99Q/C122S/Y149K/M157K | 15.7 |
| 681 | F30Y/R35W/R36K/H37S/V38D/T39Y/Y40L/V41R/Y60bN/T97aE/L97bA/H99Q/C122S/Y149R/Y151L/M157R/Q192T | 15.9 |
| 382 | V41R/H99Q/C122S/Y151L/R217V | 16 |
| 959 | V38E/Y40P/V41L/L97bG/H99L/C122S/Y151Q/R217E | 16 |
| 950 | V38E/Y40L/V41R/H99L/C122S/Y151L/R217S | 16.1 |
| 956 | V38E/Y40Q/V41L/L97bG/H99Q/C122S/Y151P/R217T | 16.4 |
| 973 | V38E/T39Y/V41R/D60aW/Y60bP/L97bR/H99I/C122S | 16.4 |
| 20 | R35W/H37D/R37aP/V38E/T39W/V41R/Y60bA/T97aI/L97bA/H99Q/C122S/Y149R | 16.6 |
| 597 | F30Y/R36H/H37F/V38E/T39Y/Y40H/V41R/Y60bD/T97aV/L97bA/H99Q/C122S/Y149L/M157K | 16.8 |
| 664 | F30Y/R35W/R36H/H37E/S37dP/V38E/T39W/Y40H/V41R/Y60bQ/T97aE/L97bA/H99Q/C122S/Y149K/M157K | 16.8 |
| 733 | R35Q/H37Y/R37aE/V38E/T39Y/V41R/D60aA/Y60bP/T97aI/L97bA/H99Q/C122S/Y149R | 17.4 |
| 469 | R36H/V38D/V41R/A96D/D97E/A98G/T97adel/H99L/L97bdel/C122S/T178S/R217D | 17.5 |
| 830 | V38D/V41R/L97bG/H99Q/C122S/Y151L/R217A | 17.7 |
| 653 | F30H/R35Q/R36H/H37Y/V38E/T39Y/Y40L/V41R/T97aI/L97bA/H99Q/C122S/Y149R/M157K | 17.8 |
| 264 | F30Y/R35W/R36K/H37E/V38E/T39W/Y40H/V41R/Y60bQ/K61E/I65T/T97aE/L97bA/H99Q/C122S/Y149K/M157K | 17.9 |
| 604 | F30Y/R35W/R36H/H37D/V38E/T39Y/Y40H/V41R/Y60bS/T97aL/L97bA/H99Q/C122S/Y149L/M157K | 18 |
| 714 | F30Y/R35Q/R36H/H37Y/R37aE/V38E/T39Y/Y40F/V41R/D60aS/Y60bP/T97aE/L97bA/H99Q/C122S/Y149R/M157K | 18.1 |
| 743 | R35Q/H37Y/R37aE/V38E/T39Y/V41R/D60aG/Y60bS/T97aI/L97bA/H99Q/C122S/Y149R | 18.1 |
| 666 | I24N/F30Y/R35W/R36H/H37E/V38E/T39W/Y40L/V41R/Y60bQ/N87D/T97aE/L97bA/H99Q/C122S/Y149K/M157K | 18.2 |
| 36 | V38E/Y40Q/V41L/L97bA/H99Q/C122S | 18.2 |
| 217 | F30Y/R35Q/H37W/V38D/Y40H/V41R/Y60bN/L97bA/H99Q/C122S/Y149H/M157K/T158A | 18.3 |
| 263 | F30Y/R35W/R36A/H37E/V38E/T39W/Y40H/V41R/Y60bQ/K61D/I65R/T97aE/L97bA/H99Q/C122S/Y149K/M157K | 18.4 |
| 221 | F30Y/R35Q/R36H/H37W/V38E/Y40H/V41R/T97aI/L97bA/H99Q/C122S/M157K | 18.6 |
| 289 | F30Y/R35Y/R36H/H37K/V38E/T39F/Y40F/V41R/T97aI/L97bA/H99Q/C122S/Y149R/M157K/K187R/K223R/K224R | 18.9 |
| 687 | R35W/R36Q/H37S/V38E/T39Y/Y40L/V41R/Y60bN/T97aE/L97bA/H99Q/C122S/Y149R/Y151L/M157S/Q192T | 19 |
| 986 | R35H/V38E/T39Y/V41R/D60aP/Y60bQ/P60cS/L97bA/H99Q/C122S/I138V/E167K | 19.4 |
| 18 | R35Q/H37Y/R37aE/V38E/T39Y/V41R/D60aT/Y60bT/T97aI/L97bA/H99Q/C122S/Y149R | 19.5 |
| 222 | I17V/F30Y/R36H/V38E/Y40H/V41R/T97aI/L97bA/H99Q/C122S/M157K | 19.6 |
| 271 | R35Y/R36H/H37K/V38E/T39F/V41R/T97aI/L97bA/H99Q/C122S/Y149R/M157K | 19.9 |
| 982 | R35H/V38E/T39Y/V41R/T56A/D60aP/Y60bQ/L97bA/H99Q/C122S | 19.9 |
| 538 | F30Y/V38D/Y40F/V41L/L97bA/H99Q/C122S/Y151L/M157R | 20.2 |
| 953 | V38E/Y40A/V41L/L97bG/H99Q/C122S/R217T | 20.4 |
| 665 | I24T/F30Y/R35W/R36H/H37E/V38E/T39W/Y40H/V41R/Y60bQ/T97aE/L97bA/H99Q/C122S/Y149K/M157K | 20.6 |
| 292 | F30Y/R35W/R36H/H37S/V38E/T39Y/Y40F/V41R/Y60bN/T97aE/L97bA/H99Q/C122S/Y149R/M157K | 20.7 |
| 219 | I17V/F30Y/V38D/Y40H/V41R/L97bA/H99Q/C122S/M157K/T158A | 21.6 |
| 747 | R35W/H37P/R37aN/V38E/T39Y/V41K/D60aP/Y60bD/T97aI/L97bA/H99Q/C122S/Y151L/Q192T | 21.7 |
| 514 | F30H/R35L/H37D/V38D/V41R/L97bA/H99Q/C122S/Y151L/M157K/R217E | 21.8 |
| 713 | F30Y/R35W/R36H/H37D/R37aE/V38E/T39Y/Y40F/V41R/D60aE/Y60bF/T97aE/L97bA/H99Q/C122S/Y149R/M157K | 21.8 |
| 619 | F30Y/R35L/R36H/H37G/V38E/T39Y/Y40H/V41R/Y60bP/T97aE/L97bA/H99Q/C122S/Y149M/M157K | 22.1 |
| 505 | I17V/F30H/V38D/V41R/L97bA/H99Q/C122S/Y151L/M157K | 22.2 |
| 623 | F30Y/R35V/R36H/H37K/V38E/T39F/Y40H/V41R/Y60bN/T97aI/L97bA/H99Q/C122S/Y149R/M157K | 22.6 |
| 11 | R35W/R36H/H37N/V38E/T39F/Y40F/V41R/T97aI/L97bA/H99Q/C122S/Y149R/M157K/Q192H | 22.8 |
| 360 | R35V/Y40Q/V41L/Y60bS/T97aE/L97bA/H99Q/C122S/Y149R | 22.8 |

TABLE 14-continued

| SEQ ID NO* | Mutation String | ED50 (nM) |
|---|---|---|
| 729 | F30Y/R35M/R36H/H37G/R37aE/V38E/T39Y/Y40F/V41R/D60aP/Y60bS/T97aE/L97bA/H99Q/C122S/Y149R/M157K | 22.9 |
| 834 | R35Q/V38D/V41R/L97bG/H99Q/C122S/Y151L | 22.9 |
| 961 | R37aS/V38E/Y40P/V41L/L97bG/H99Q/C122S/Y151Q/R217T | 23.4 |
| 364 | R35V/R37aE/V38E/Y40Q/V41L/T97aE/L97bA/H99Q/C122S/Y149R | 23.5 |
| 486 | F30H/V38D/V41R/A96G/L97bA/H99Q/C122S/Y151L/M157K | 23.7 |
| 311 | T39L/Y40L/V41R/T97aI/L97bA/H99Q/C122S | 23.7 |
| 265 | F30Y/R35W/R36H/H37E/V38E/T39Y/Y40F/V41R/Y60bQ/T97aE/L97bA/H99Q/C122S/Y149R/M157K | 23.8 |
| 34 | Y40Q/V41L/Y60bL/L97bA/H99Q/C122S | 23.9 |
| 586 | F30Y/R36H/V38D/Y40H/V41R/T97aI/L97bA/H99Q/C122S/S146F/M157K/Q192H/K243Q | 24.1 |
| 346 | Y40Q/V41L/L97bA/H99Q/C122S/Y149R | 24.1 |
| 262 | F30Y/R35W/R36Q/H37E/V38E/T39W/Y40H/V41R/Y60bQ/K61L/I65V/T97aE/L97bA/H99Q/C122S/Y149K/M157K | 24.4 |
| 21 | R35Q/H37Y/R37aE/V38E/T39Y/V41R/D60aP/Y60bQ/T97aI/L97bA/H99Q/C122S/Y149R | 24.5 |
| 832 | R35Q/V38D/V41R/T97aS/L97bA/H99Q/C122S/Y151L | 24.8 |
| 369 | V41R/L97bR/H99Q/C122S/Y151L/R217V | 25.1 |
| 30 | R35Q/H37Y/R37aE/V38E/T39Y/V41R/D60aP/Y60bQ/L97bA/H99Q/C122S/Y149R | 25.3 |
| 621 | F30Y/R35V/R36H/H37S/V38E/T39Y/Y40H/V41R/Y60bP/T97aE/L97bA/H99Q/C122S/Y149E/M157K | 25.4 |
| 754 | R35A/H37T/R37aD/V38E/T39Y/V41R/D60aP/Y60bD/T97aI/L97bA/H99Q/C122S/Y151L/Q192S | 25.5 |
| 835 | R35S/V38D/V41R/L97bA/H99Q/C122S/Y151L | 25.7 |
| 836 | R35S/V38D/V41L/L97bG/H99Q/C122S/Y151L/R217Q | 26.1 |
| 562 | F30Y/R35H/V38D/Y40H/V41R/L97bA/H99Q/C122S/M157K/T158S | 26.3 |
| 738 | R35Q/H37S/R37aE/V38E/T39Y/V41R/D60aP/Y60bS/T97aI/L97bA/H99Q/C122S/Y149R | 26.3 |
| 338 | H37G/R37aD/V38F/T39H/V41R/Y60bK/L97bR/H99E/C122S/Y151L/E175D/Q192T/R217E/K224R | 26.7 |
| 341 | H37G/R37aD/V38F/T39H/V41R/Y60bK/L97bR/H99E/C122S/Y151L/E175D/Q192T/R217E | 26.8 |
| 741 | R35W/H37D/R37aS/V38E/T39Y/V41R/D60aE/Y60bS/T97aI/L97bA/H99Q/C122S/Y149R | 26.9 |
| 795 | R35Q/H37G/R37aD/V38E/T39Y/V41R/D60aP/Y60bA/T97aI/L97bA/H99Q/C122S/Y149R | 27.1 |
| 798 | R35Q/H37D/R37aK/V38E/T39F/V41R/D60aP/Y60bS/T97aI/L97bA/H99Q/C122S/Y149R | 27.1 |
| 671 | R35Y/R36H/H37S/V38D/T39Y/V41R/Y60bN/T97aI/L97bA/H99Q/C122S/Y149R | 27.3 |
| 230 | F30Y/R36H/V38E/Y40H/V41R/K61E/T97aI/L97bA/H99Q/C122S/M157K | 27.9 |
| 829 | R37aS/V38D/V41Q/L97bG/H99Q/C122S/Y151L/R217T | 27.9 |
| 484 | F30H/V38D/V41R/L97bA/H99Q/C122S/Y151L/M157K | 28.1 |
| 693 | F30Y/R35K/R36H/H37E/R37aK/V38E/T39F/Y40F/V41R/D60aP/Y60bS/T97aI/L97bA/H99Q/C122S/Y149R/M157K | 28.1 |
| 694 | F30Y/R35Q/R36H/H37G/R37aE/V38E/T39Y/Y40F/V41R/D60aP/Y60bG/T97aI/L97bA/H99Q/C122S/Y149R/M157K | 28.3 |
| 261 | F30Y/R35W/R36Q/H37E/V38A/T39W/Y40H/V41R/Y60bQ/K61D/I65V/T97aE/L97bA/H99Q/C122S/Y149K/M157K | 28.4 |
| 494 | F30Y/R35H/V38D/Y40H/V41R/T56A/L97bA/H99Q/C122S/M157K | 28.5 |
| 797 | R35N/H37T/R37aY/V38E/T39Y/V41R/D60aP/Y60bE/T97aI/L97bA/H99Q/C122S/Y149R | 28.7 |
| 984 | R37aH/V38E/T39Y/V41R/T56A/D60aP/Y60bQ/L97bA/H99Q/C122S/T158A | 28.8 |
| 515 | F30H/R35Q/H37T/V38D/V41R/L97bA/H99Q/C122S/Y151L/M157K | 28.9 |
| 503 | F30H/R36L/V38E/V41R/K82R/L97bA/H99Q/C122S/Y151L/M157K | 29 |
| 370 | V38D/V41R/H99Q/C122S/Y151L/R217V | 29.1 |
| 736 | R35Q/H37G/R37aP/V38E/T39Y/V41R/D60aP/Y60bE/T97aI/L97bA/H99Q/C122S/Y149R | 29.2 |
| 726 | F30Y/R35Q/R36H/H37Y/R37aE/V38E/T39Y/Y40F/V41R/D60aE/Y60bA/T97aE/L97bA/H99Q/C122S/Y149R/M157K | 29.3 |
| 704 | R35Q/H37Y/R37aD/V38E/T39L/V41R/D60aE/Y60bT/T97aI/L97bA/H99Q/C122S/Y149R | 29.4 |
| 657 | F30Y/R35L/R36H/H37E/V38E/T39N/Y40F/V41R/T97aI/L97bA/H99Q/C122S/Y149R/M157K | 29.6 |
| 963 | R36S/V38E/Y40L/V41N/L97bG/H99Q/C122S/Y151L/R217T | 29.6 |
| 401 | T39W/V41R/L97bG/H99Q/C122S | 29.7 |
| 9 | F30Y/R35W/R36H/H37E/V38E/T39W/Y40H/V41R/Y60bQ/T97aE/L97bA/H99Q/C122S/Y149K/M157K | 29.8 |
| 28 | R35Q/H37Y/R37aE/V38E/T39Y/V41R/Y60bQ/T97aI/L97bA/H99Q/C122S/Y149R | 29.8 |
| 940 | R35S/R37aA/V38E/Y40Q/V41L/L97bA/H99Q/C122S/Y149V | 30.2 |
| 612 | F30Y/R35W/R36H/H37Q/V38E/T39H/Y40H/V41R/T97aE/L97bA/H99Q/C122S/Y149L/M157K | 30.3 |
| 715 | F30Y/R35Q/R36H/H37Y/R37aD/V38E/T39Y/Y40F/V41R/Y60bV/T97aE/L97bA/H99Q/C122S/Y149R/M157K | 30.4 |
| 171 | F30H/V38D/V41R/L97bA/H99Q/Y151L/M157K | 30.6 |
| 511 | F30R/R35H/H37I/V38D/V41R/L97bA/H99Q/C122S/Y149W/Y151L/M157K/R217S | 30.6 |
| 875 | V38D/T39Y/Y40H/V41R/T97aI/L97bA/H99Q/C122S | 30.7 |

TABLE 14-continued

| SEQ ID NO* | Mutation String | ED50 (nM) |
|---|---|---|
| 702 | R35F/H37D/R37aN/V38E/T39Y/V41R/Y60bS/T97aI/L97bA/H99Q/C122S/Y149R | 30.9 |
| 402 | T39Y/V41R/Y60bQ/L97bG/H99Q/C122S | 31.1 |
| 398 | T39Y/V41R/D60aP/Y60bQ/L97bA/H99Q/C122S | 31.4 |
| 881 | V38D/V41R/L97bR/H99Q/C122S/Y151L/R217E | 31.5 |
| 924 | R36S/V38D/T39L/Y40L/V41R/L97bI/H99E/C122S/R217T | 31.5 |
| 936 | R35S/R37aD/V38E/Y40Q/V41L/Y60bV/T97aL/L97bA/H99Q/C122S/Y149L | 31.5 |
| 350 | Y40Q/V41L/Y60bT/T97aE/L97bA/H99Q/C122S/Y149R | 31.6 |
| 496 | F30Y/V38E/Y40H/V41R/T56A/L97bA/H99Q/C122S/M157K/K243M | 31.9 |
| 231 | F30Y/R36H/R37aH/V38E/Y40H/V41R/K61E/T97aI/L97bA/H99Q/C122S/M157K | 31.9 |
| 516 | F30H/R35Q/V38D/V41R/L97bA/H99Q/C122S/Y151L/M157K | 32 |
| 818 | V38D/V41R/Y60bK/T97aS/L97bR/H99E/C122S/Y151L/E175D/Q192T/R217E/K224R | 32 |
| 324 | H37G/G37bD/V38F/T39H/V41R/Y60bK/T97aS/L97bR/H99E/C122S/Y151L/E175D/Q192T/R217E/K224R | 32.1 |
| 948 | R35S/R37aD/V38E/Y40Q/V41L/T97aE/L97bA/H99Q/C122S/Y149R | 32.2 |
| 368 | R35V/R37aE/V38E/Y40Q/V41L/Y60bS/T97aE/L97bA/H99Q/C122S | 32.2 |
| 351 | Y40Q/V41L/Y60bS/T97aE/L97bA/H99Q/C122S/Y149R | 32.5 |
| 551 | F30Y/R35H/V38D/Y40H/V41R/L97bA/H99Q/C122S/I138V/M157K | 33.1 |
| 43 | T39Y/V41R/Y60bQ/L97bA/H99Q/C122S | 33.2 |
| 696 | F30Y/R35H/R36H/H37D/R37aE/V38E/T39Y/Y40F/V41R/D60aP/Y60bD/T97aI/L97bA/H99Q/C122S/Y149R/M157K | 33.4 |
| 495 | F30Y/V38D/Y40H/V41R/L97bA/H99Q/C122S/M157K/T158A | 33.5 |
| 972 | V38E/T39W/V41R/D60aP/Y60bD/L97bA/H99L/C122S | 33.5 |
| 242 | F30Y/R36H/V38E/Y40H/V41R/I65T/T97aI/L97bA/H99Q/C122S/M157K | 33.6 |
| 884 | V38D/V41R/L97bR/H99Q/C122S/Y151L/R217V | 33.7 |
| 801 | R35Q/H37S/R37aP/V38E/T39Y/V41R/D60aP/Y60bE/T97aI/L97bA/H99Q/C122S/Y149R | 33.8 |
| 673 | R35W/R36H/H37S/V38E/T39Y/V41R/Y60bN/T97aE/L97bA/H99Q/C122S/Y149R/M157K | 34 |
| 958 | R36S/V38E/Y40Q/V41L/L97bG/H99L/C122S/Y151P/R217E | 34.3 |
| 15 | V38E/Y40Q/V41L/Y60bL/L97bA/H99Q/C122S | 34.5 |
| 340 | H37G/R37aD/G37bD/V38F/T39H/V41R/Y60bK/L97bR/H99E/C122S/Y151L/E175D/Q192T/R217E | 34.5 |
| 339 | H37G/R37aD/V38F/T39H/V41R/Y60bK/T97aS/L97bR/H99E/C122S/Y151L/E175D/Q192T/R217E | 34.8 |
| 282 | F30Y/R35Y/R36H/H37K/V38E/T39F/Y40F/V41R/T97aI/L97bA/H99Q/C122S/Y149R/M157K/K187S/K223S/K224Y | 34.9 |
| 39 | Y40Q/V41L/L97bA/H99Q/C122S | 35.2 |
| 504 | F30H/R35H/V38D/V41R/K61E/L97bA/H99Q/C122S/Y151L/M157K/R206H | 35.4 |
| 8 | F30Y/V38D/Y40H/V41R/L97bA/H99Q/C122S/M157K | 35.7 |
| 273 | F30Y/R36H/V38E/Y40H/V41R/T97aE/L97bA/H99Q/C122S/Y149R/M157K | 35.7 |
| 943 | R35A/R37aE/V38E/Y40Q/V41L/L97bA/H99Q/C122S/Y149R | 35.9 |
| 827 | V38D/V41L/L97bG/H99Q/C122S/Y151L/R217Q | 36.2 |
| 517 | F30H/R35Q/H37W/V38D/V41R/D60aE/L97bA/H99Q/C122S/Y149L/Y151L/M157K/R217D | 36.4 |
| 620 | F30Y/R35F/R36H/H37G/V38E/T39Y/Y40H/V41R/Y60bS/T97aD/L97bA/H99Q/C122S/Y149R/M157K | 36.7 |
| 399 | T39Y/V41R/L97bG/H99Q/C122S | 36.8 |
| 608 | F30Y/R35I/R36H/H37E/V38E/T39Y/Y40H/V41R/Y60bS/T97aV/L97bA/H99Q/C122S/Y149L/M157K | 36.9 |
| 934 | R35S/R37aD/V38E/Y40Q/V41L/L97bA/H99Q/C122S/Y149R | 37.2 |
| 387 | Y40H/V41Q/L97bG/H99Q/C122S/R217T | 37.2 |
| 645 | R35W/H37D/V38D/T39Y/V41R/Y60bS/L97bA/H99Q/C122S/Y149R | 37.4 |
| 869 | V38D/T39F/Y40L/V41R/T97aW/L97bA/H99Q/C122S | 37.8 |
| 878 | V38D/T39Y/Y40L/V41R/T97aE/L97bA/H99Q/C122S | 37.8 |
| 718 | F30Y/R35Q/R36H/H37G/R37aE/V38E/T39F/Y40F/V41R/D60aP/Y60bS/T97aE/L97bA/H99Q/C122S/Y149R/M157K | 38.2 |
| 873 | V38D/T39L/Y40L/V41R/T97aI/L97bA/H99Q/C122S | 38.2 |
| 876 | V38D/T39Y/Y40L/V41R/T97aW/L97bA/H99Q/C122S | 38.4 |
| 550 | F30Y/R36H/V38D/Y40H/V41R/L97bA/H99L/C122S/F141L/M157K/T158A | 38.5 |
| 728 | F30Y/R35Q/R36H/H37G/R37aE/V38E/T39Y/Y40F/V41R/D60aA/Y60bS/T97aE/L97bA/H99Q/C122S/Y149R/M157K | 38.5 |
| 712 | F30Y/R35Q/R36H/H37G/R37aE/V38E/T39Y/Y40F/V41R/D60aP/Y60bS/T97aE/L97bA/H99Q/C122S/Y149R/M157K | 38.6 |
| 404 | T39Y/V41R/Y60bP/L97bG/H99Q/C122S | 39.2 |
| 507 | F30H/R36H/V38D/V41R/T56A/L97bA/H99Q/C122S/Y151L/M157K | 40 |
| 720 | F30Y/R35E/R36H/H37D/R37aN/V38E/T39Y/Y40F/V41R/Y60bN/T97aE/L97bA/H99Q/C122S/Y149R/M157K | 40 |
| 268 | V38E/Y40Q/V41L/D60aP/Y60bL/L97bA/H99Q/C122S/Y149W | 40.4 |
| 498 | F30Y/R36H/V38E/Y40H/V41R/T97aI/L97bA/H99Q/C122S/M157K | 40.5 |
| 509 | F30H/R35Q/H37W/V38D/V41R/D60aE/Y60bS/L97bA/H99Q/C122S/Y149L/Y151L/M157K | 40.8 |
| 742 | R35Q/H37G/R37aE/V38E/T39Y/V41R/D60aP/Y60bT/T97aI/L97bA/H99Q/C122S/Y149R | 40.9 |
| 686 | F30Y/R35W/R36H/H37S/V38E/T39Y/Y40H/V41R/Y60bN/T97aE/L97bA/H99Q/C122S/Y149R/Y151P/M157K/Q192H | 41 |
| 710 | F30Y/R35M/R36H/H37D/R37aD/V38E/T39Y/Y40F/V41R/D60aP/Y60bS/T97aE/L97bA/H99Q/C122S/Y149R/M157K | 41.2 |

TABLE 14-continued

| SEQ ID NO* | Mutation String | ED50 (nM) |
|---|---|---|
| 618 | F30Y/R35W/R36H/H37D/V38E/T39Y/Y40H/V41R/Y60bT/T97aD/L97bA/H99Q/C122S/Y149R/M157K | 41.3 |
| 872 | V38D/T39L/Y40L/V41R/T97aV/L97bA/H99Q/C122S | 41.6 |
| 822 | V38D/V41R/Y60bS/T97aI/L97bR/H99E/C122S/Y151L/E175D/Q192F/R217E/K224R | 42.1 |
| 403 | T39Y/V41R/Y60bP/L97bA/H99Q/C122S | 42.1 |
| 446 | R36H/V38D/Y40F/V41R/D97E/A98G/T97adel/H99L/L97bdel/C122S/Y151L/Q192E/R217D | 42.2 |
| 735 | R35M/H37G/R37aD/V38E/T39W/V41R/D60aP/Y60bD/T97aI/L97bA/H99Q/C122S/Y149R | 42.3 |
| 543 | F30Y/V38D/Y40L/V41R/L97bA/H99Q/C122S/Y151L/M157K/Q192H | 42.4 |
| 475 | F30H/V38D/Y40F/V41R/L97bA/H99Q/C122S/Y151L/M157F | 42.5 |
| 697 | H37M/R37aD/V38E/T39A/V41R/D60aP/Y60bS/T97aI/L97bA/H99Q/C122S/Y149R | 42.7 |
| 171 | F30H/V38D/V41R/L97bA/H99Q/Y151L/M157K | 42.8 |
| 552 | T22I/F30Y/R35S/V38D/Y40H/V41R/L97bA/H99Q/C122S/I138V/M157K | 42.9 |
| 734 | R35L/H37D/R37aS/V38E/T39Y/V41R/D60aP/Y60bD/T97aI/L97bA/H99Q/C122S/Y149R | 42.9 |
| 561 | F30Y/R35L/V38D/Y40H/V41R/N76S/L97bA/H99Q/C122S/M157K/K187E | 43.6 |
| 481 | F30H/V38D/V41R/L97bA/H99Q/C122S/Y151L/M157S | 43.8 |
| 648 | R35W/H37D/V38D/T39Y/V41R/Y60bH/L97bA/H99Q/C122S/Y149R | 44.2 |
| 595 | F30Y/R36H/H37G/V38E/T39W/Y40H/V41R/Y60bA/T97aE/L97bA/H99Q/C122S/Y149Q/M157K | 44.6 |
| 904 | R35Q/H37G/R37aE/V38W/T39Y/V41R/Y60bK/T97aS/L97bR/H99E/C122S/Y151L/E175D/Q192T/R217E/K224R | 44.6 |
| 330 | H37G/R37aD/G37bD/V38F/T39H/V41R/Y60bK/L97bR/H99E/C122S/Y151L/E175D/Q192T/R217E/K224R | 44.6 |
| 879 | V38D/T39Y/Y40M/V41R/T97aE/L97bA/H99Q/C122S | 45 |
| 647 | R35Q/H37N/V38D/T39Y/V41R/Y60bP/L97bA/H99Q/C122S | 45.4 |
| 663 | F30Y/R35W/R36H/H37D/V38E/T39Y/Y40F/V41R/Y60bS/T97aE/L97bA/H99Q/C122S/Y149K/M157K | 45.8 |
| 23 | R35Q/R37aE/V38E/T39Y/V41R/D60aP/Y60bQ/T97aI/L97bA/H99Q/C122S/Y149R | 46.1 |
| 975 | V38E/T39L1V41R/D60aN/Y60bP/L97bG/H99Q/C122S | 46.8 |
| 601 | F30Y/R36H/H37A/V38E/T39Y/Y40H/V41R/Y60bQ/T97aV/L97bA/H99Q/C122S/Y149R/M157K | 46.9 |
| 722 | F30Y/R35W/R36H/H37E/R37aP/V38E/T39Y/Y40F/V41R/Y60bN/T97aE/L97bA/H99Q/C122S/Y149Q/M157K | 47.7 |
| 748 | H37T/R37aL/V38E/T39Y/V41R/D60aP/Y60bD/T97aI/L97bA/H99Q/C122S/Y151L/Q192R | 47.9 |
| 325 | H37G/R37aD/V38F/T39H/V41R/Y60bK/T97aS/L97bR/H99E/C122S/Y151L/E175D/Q192T/R217E/K224R | 47.9 |
| 667 | F30Y/R35W/R36H/H37S/V38E/Y40H/Y60bN/T97aE/L97bA/H99Q/C122S/Y149R/M157K | 48.6 |
| 868 | V38D/T39W/Y40L/V41R/T97aL/L97bA/H99Q/C122S | 48.9 |
| 326 | H37G/R37aD/G37bD/T39H/V41R/Y60bK/T97aS/L97bR/H99E/C122S/Y151L/E175D/Q192T/R217E/K224R | 49 |
| 42 | T39Y/V41R/L97bA/H99Q/C122S | 49 |
| 874 | V38D/T39L/Y40L/V41R/T97aW/L97bA/H99Q/C122S | 49.1 |
| 584 | F30Y/R36H/V38E/Y40H/V41R/T97aI/L97bA/H99Q/C122S/Y149N/L150V/M157K | 49.3 |
| 534 | R35S/V38D/L97bA/H99Q/C122S/Y151L/M157Y | 49.8 |
| 925 | R37aS/V38D/T39Y/Y40F/V41R/H99L/C122S/R217T | 49.9 |
| 349 | Y40Q/V41L/Y60bE/L97bA/H99Q/C122S/Y149R | 49.9 |
| 390 | Y40H/V41T/L97bC/H99Q/C122S/R217T | 50 |
| 506 | F30H/R35S/V38E/V41R/Y60bH/L97bA/H99Q/C122S/Y151L/M157K | 50.1 |
| 877 | V38D/T39Y/Y40M/V41R/T97aW/L97bA/H99Q/C122S | 50.1 |
| 900 | H37G/R37aD/G37bD/V38F/T39H/V41R/Y60bK/T97aS/L97bR/H99E/C122S/Y151L/E175D/Q192T/R217E/K224R | 50.9 |
| 737 | R35A/H37G/R37aE/V38E/T39F/V41R/D60aE/Y60bP/T97aI/L97bA/H99Q/C122S/Y149R | 51.1 |
| 22 | H37Y/R37aE/V38E/T39Y/V41R/D60aP/Y60bQ/T97aI/L97bA/H99Q/C122S/Y149R | 51.1 |
| 598 | F30Y/R36H/H37N/V38E/T39Y/Y40H/V41R/Y60bQ/T97aV/L97bA/H99Q/C122S/Y149L/M157K | 51.4 |
| 545 | F30Y/V38D/Y40L//V41R/L97bA/H99Q/C122S/Y151L/M157A/Q192Y | 51.5 |
| 954 | V38E/Y40H/V41Q/L97bG/H99Q/C122S/R217T | 51.6 |
| 870 | V38D/T39Y/Y40Q/V41L/T97aY/L97bA/H99Q/C122S | 51.7 |
| 942 | R35V/R37aE/V38E/Y40Q/V41L/Y60bS/T97aE/L97bA/H99Q/C122S/Y149R | 51.7 |
| 358 | R35S/Y40Q/V41L/Y60bT/T97aE/L97bA/H99Q/C122S/Y149R | 52.4 |
| 535 | F30H/V38D/V41R/L97bA/H99Q/C122S/Y151L/M157T | 52.9 |
| 356 | R35K/Y40Q/V41L/Y60bE/L97bA/H99Q/C122S/Y149R | 53.2 |
| 692 | F30Y/R35V/R36H/H37T/V38E/T39A/Y40L/V41Q/T97aI/L97bA/H99Q/C122S/Y149R/M157K | 53.7 |
| 184 | F30H/V38D/V41R/L97bA/H99Q/C122S/Y151L/M157K/R217D | 54 |
| 249 | F30Y/R36H/V38E/Y40H/V41R/I65T/T97aI/L97bA/H99Q/C122S/Y149R/M157K | 54.1 |
| 672 | R36H/H37S/V38E/T39W/V41R/Y60bN/T97aI/L97bA/H99Q/C122S/Y149R | 54.1 |
| 371 | V38D/V41R/L97bR/C122S/Y151L/R217V | 54.3 |
| 553 | F30Y/R36S/V38D/T39I/Y40H/V41R/L97bA/H99Q/C122S/S146P/M157K/T158S | 54.6 |
| 365 | R35V/R37aE/V38E/Y40Q/V41L/Y60bS/L97bA/H99Q/C122S/Y149R | 54.6 |
| 37 | V38E/Y40Q/V41L/Y60bL/H99Q/C122S | 54.9 |
| 347 | R37aE/Y40Q/V41L/L97bA/H99Q/C122S | 54.9 |

TABLE 14-continued

| SEQ ID NO* | Mutation String | ED50 (nM) |
|---|---|---|
| 709 | F30Y/R35Q/R36H/H37G/R37aE/V38E/T39F/Y40F/V41R/D60aS/Y60bP/T97aE/L97bA/H99Q/C122S/Y149R/M157K | 55.3 |
| 487 | F30H/G37bD/V38D/T39H/V41R/L97bA/H99Q/R110dH/C122S/Y151L/M157K/S240I | 55.5 |
| 902 | R35K/H37A/R37aE/V38H/T39Y/V41R/Y60bK/T97aS/L97bR/H99E/C122S/Y151L/E175D/Q192T/R217E/K224R | 55.9 |
| 603 | F30Y/R36H/H37D/V38E/T39W/Y40H/V41R/Y60bN/T97aV/L97bA/H99Q/C122S/Y149R/M157K | 56 |
| 25 | R35Q/H37Y/R37aE/T39Y/V41R/D60aP/Y60bQ/T97aI/L97bA/H99Q/C122S/Y149R | 56.2 |
| 436 | V38D/V41R/A96D/D97G/A98G/T97adel/H99L/L97bdel/C122S/Y151L/Q192E/R217D | 56.3 |
| 606 | F30Y/R36H/H37E/V38E/T39F/Y40H/V41R/Y60bN/T97aV/L97bA/H99Q/C122S/Y149R/M157K | 56.4 |
| 337 | H37G/R37aD/G37bD/V38F/T39H/V41R/Y60bK/T97aS/L97bR/H99E/C122S/Y151L/E175D/Q192T/R217E | 56.4 |
| 587 | F30Y/R36H/V38E/Y40H/V41R/K61E/T97aI/L97bA/H99Q/C122S/Y149H/M157K/K187R | 57.7 |
| 232 | F30Y/R36H/V38E/Y40H/V41R/K61E/T97aI/L97bA/H99Q/C122S/Y149R/M157K | 58 |
| 44 | T39Y/V41R/D60aP/L97bA/H99Q/C122S | 58.2 |
| 329 | H37G/R37aD/G37bD/V38F/T39H/V41R/T97aS/L97bR/H99E/C122S/Y151L/E175D/Q192T/R217E/K224R | 58.5 |
| 216 | I17V/F30Y/R35Q/H37W/V38D/Y40H/V41R/Y60bN/L97bA/H99Q/C122S/Y149H/M157K | 58.6 |
| 519 | F30Y/R35Q/V38D/Y40H/V41R/L97bA/H99Q/C122S/Y149W/M157K/R217D | 58.8 |
| 270 | F30Y/R36H/V38E/Y40H/V41R/T97aE/L97bA/H99Q/C122S/M157K | 59.3 |
| 348 | R37aE/Y40Q/V41L/L97bA/H99Q/C122S/Y149R | 59.3 |
| 793 | R35N/H37S/R37aE/V38E/T39F/V41R/D60aP/Y60bE/T97aI/L97bA/H99Q/C122S/Y149R | 59.5 |
| 226 | F30Y/R36H/V38E/Y40H/V41R/T97aI/L97bA/H99Q/C122S/Y149R/M157K | 59.9 |
| 719 | F30Y/R35Q/R36H/H37G/R37aL/V38E/T39N/Y40F/V41R/D60aP/Y60bT/T97aE/L97bA/H99Q/C122S/Y149R/M157K | 59.9 |
| 625 | F30Y/R35V/R36H/H37G/V38E/T39L/Y40H/V41R/Y60bT/T97aI/L97bA/H99Q/C122S/Y149R/M157K/Q192T/R239H | 60.1 |
| 903 | R35Q/H37G/R37aE/V38Y/T39F/V41R/Y60bK/T97aS/L97bR/H99E/C122S/Y151L/E175D/Q192T/R217E/K224R | 60.1 |
| 35 | V38E/Y40Q/Y60bL/L97bA/H99Q/C122S | 60.2 |
| 176 | F30H/V38D/V41R/L97bA/H99Q/C122S/Y149N/Y151L/M157K | 60.3 |
| 381 | H99Q/C122S/Y151L/R217V | 60.4 |
| 841 | R35S/V38D/Y40H/V41L/Y60bD/L97bG/H99Q/C122S | 61.5 |
| 698 | R35F/H37D/R37aS/V38E/T39Y/V41R/D60aE/Y60bD/T97aI/L97bA/H99Q/C122S/Y149R | 63.4 |
| 935 | R35V/R37aD/V38E/Y40Q/V41L/Y60bG/T97aE/L97bA/H99Q/C122S/Y149R | 63.5 |
| 951 | R36L/V38E/Y40Q/V41R/L97bG/H99Q/C122S/Y151P/R217S | 63.7 |
| 600 | F30Y/R36H/H37D/V38E/T39W/Y40H/V41R/Y60bV/T97aE/L97bA/H99Q/C122S/Y149R/M157K | 63.9 |
| 607 | F30Y/R36H/H37G/V38E/T39Y/Y40H/V41R/Y60bN/T97aA/L97bA/H99Q/C122S/Y149R/M157K | 64.2 |
| 947 | R37aD/V38E/Y40Q/V41L/Y60bP/T97aV/L97bA/H99Q/C122S/Y149K | 64.8 |
| 555 | F30Y/R35L/V38D/Y40H/V41R/L97bA/H99Q/C122S/M157K | 65.1 |
| 357 | R37aD/Y40Q/V41L/Y60bT/T97aE/L97bA/H99Q/C122S/Y149R | 65.3 |
| 699 | R35A/H37D/R37aN/V38E/T39F/V41R/D60aP/Y60bD/T97aI/L97bA/H99Q/C122S/Y149R | 65.8 |
| 198 | I17V/F30Y/V38D/Y40H/V41R/L97bA/H99Q/C122S/M157K | 66 |
| 267 | V38E/Y40Q/V41Q/D60aP/Y60bL/L97bA/H99Q/C122S/Y149W | 66 |
| 711 | F30Y/R35Q/R36H/H37G/R37aN/V38E/T39Y/Y40F/V41R/Y60bA/T97aE/L97bA/H99Q/C122S/Y149R/M157K | 66.2 |
| 849 | V38D/V41R/Y60bR/L97bR/H99E/C122S/Y151L/E175D/Q192T/R217E/K224R | 66.2 |
| 518 | F30H/R35Q/V38D/V41R/Y60bE/L97bA/H99Q/C122S/Y149N/Y151L/M157K | 66.3 |
| 313 | V38D/T39L/V41R/T97aI/L97bA/H99Q/C122S | 66.3 |
| 937 | R37aP/V38E/Y40Q/V41L/Y60bE/L97bA/H99Q/C122S/Y149R | 67.2 |
| 591 | F30Y/R36H/H37S/V38E/T39L/Y40H/V41R/Y60bH/T97aI/L97bA/H99Q/C122S/Y149R/M157K | 67.5 |
| 901 | R35Q/H37G/R37aE/V38Y/T39H/V41R/Y60bK/T97aS/L97bR/H99E/C122S/Y151L/E175D/Q192T/R217E/K224R | 67.6 |
| 955 | V38E/Y40H/V41T/L97bG/H99Q/C122S/R217T | 67.8 |
| 833 | V38D/V41Q/L97bG/H99Q/C122S/Y151L/R217T | 68.6 |
| 417 | V38D/V41R/A96D/D97G/A98G/T97adel/H99L/L97bdel/C122S/R217D | 68.8 |
| 695 | F30Y/R35Q/R36H/H37G/R37aE/V38E/T39I/Y40F/V41R/D60aP/Y60bD/T97aI/L97bA/H99Q/C122S/Y149M/M157K | 69.2 |
| 893 | R35G/H37T/R37aE/V38T/T39Y/V41Q/Y60bR/T97aF/L97bR/H99E/C122S/Y151L/E175D/Q192T/R217E/K224R | 69.7 |
| 932 | R37aS/V38D/T39Y/V41R/L97bI/H99E/C122S/R217T | 70.1 |
| 233 | F30Y/R36H/R37aH/V38E/Y40H/V41R/K61E/T97aI/L97bA/H99Q/C122S/Y149R/M157K | 70.3 |
| 661 | F30H/R35L/R36H/H37E/V38E/T39F/Y40F/V41R/T97aI/L97bA/H99Q/C122S/Y149R/M157K | 70.4 |

TABLE 14-continued

| SEQ ID NO* | Mutation String | ED50 (nM) |
|---|---|---|
| 629 | F30Y/R35W/R36H/H37E/V38E/T39Y/Y40H/V41R/Y60bD/T97aI/L97bA/H99Q/C122S/Y149R/M157K/Q192M | 70.8 |
| 807 | V38E/T39L/V41R/D60aP/Y60bD/T97aI/L97bA/H99Q/C122S/Y149V/Y151L/Q192T | 71.1 |
| 199 | F30Y/V38D/Y40H/V41R/L97bA/H99Q/C122S/Y149W/M157K | 71.3 |
| 725 | F30Y/R35F/R36H/H37D/R37aD/V38E/T39H/Y40F/V41R/D60aP/Y60bA/T97aE/L97bA/H99Q/C122S/Y149R/M157K | 71.3 |
| 565 | F30H/R35Q/H37Y/V38D/V41R/D60aE/Y60bN/L97bA/H99Q/C122S/Y149R/Y151L/M157K | 71.4 |
| 376 | L97bR/H99Q/C122S/Y151L/R217V | 72.3 |
| 960 | R37aS/V38E/Y40H/V41T/L97bG/H99Q/C122S/R217T | 72.6 |
| 307 | Y40Q/Y60bL/L97bA/H99Q/C122S | 73 |
| 466 | R36H/G37cD/V38D/V41R/A96D/D97G/A98G/T97adel/H99L/L97bdel/C122S/M157T/R217D | 75 |
| 839 | R35K/V38D/Y40H/V41R/Y60bS/L97bG/H99Q/C122S | 75.6 |
| 299 | R35Q/H37Y/R37aE/V38D/T39Y/V41R/D60aP/Y60bQ/T97aI/L97bA/H99Q/C122S/Y149R | 77.3 |
| 592 | F30Y/R35L/R36H/H37D/V38E/T39W/Y40H/V41R/Y60bA/T97aD/L97bA/H99Q/C122S/Y149R/M157K | 77.9 |
| 520 | F30Y/R35Q/H37W/V38D/Y40H/V41R/Y60bN/L97bA/H99Q/C122S/Y149H/M157K | 78.3 |
| 389 | Y40H/V41Q/L97bG/H99Q/C122S | 78.4 |
| 400 | T39H/V41R/L97bG/H99Q/C122S | 78.4 |
| 315 | V38D/T39L/Y40L/V41R/L97bA/H99Q/C122S | 79 |
| 740 | R35Q/H37G/R37aE/V38E/T39H/V41R/D60aP/Y60bA/T97aI/L97bA/H99Q/C122S/Y149R | 80.1 |
| 716 | F30Y/R35A/R36H/H37T/R37aD/V38E/T39Y/Y40L/V41R/D60aP/Y60bE/T97aE/L97bA/H99Q/C122S/Y149R/M157K | 80.7 |
| 700 | R35Q/H37D/R37aA/V38E/T39F/V41R/D60aP/Y60bE/T97aI/L97bA/H99Q/C122S/Y149R | 80.7 |
| 312 | V38D/Y40L/V41R/T97aI/L97bA/H99Q/C122S | 80.7 |
| 651 | F30Y/R35L/R36H/H37D/V38E/T39Y/Y40F/V41R/T97aI/L97bA/H99Q/C122S/Y149R/M157K/Q192N | 80.9 |
| 871 | R37aS/V38D/T39Y/Y40M/V41R/T97aL/L97bA/H99Q/C122S | 81.2 |
| 374 | R35V/R37aE/Y40Q/V41L/Y60bS/T97aE/L97bA/H99Q/C122S/Y149R | 81.4 |
| 359 | R37aE/Y40Q/V41L/Y60bS/T97aE/L97bA/H99Q/C122S/Y149R | 81.5 |
| 938 | R35M/R37aQ/V38E/Y40Q/V41L/Y60bE/T97aE/L97bA/H99Q/C122S/Y149R | 81.6 |
| 38 | V38E/Y40Q/V41L/Y60bL/L97bA/C122S | 82.9 |
| 243 | F30Y/R36H/V38E/Y40L/V41R/T97aI/L97bA/H99Q/C122S/M157K | 83.5 |
| 500 | F30Y/R35H/V38D/T39S/Y40L/V41R/L97bA/H99Q/C122S/T147S/M157K | 84.7 |
| 564 | F30H/V38D/V41R/L97bA/H99Q/C122S/Y151L/M157K/Q192H/R239H | 85.7 |
| 721 | F30Y/R36H/H37M/R37aD/V38E/T39G/Y40F/V41R/D60aP/Y60bE/T97aE/L97bA/H99Q/C122S/Y149R/M157K | 85.9 |
| 523 | F30Y/R35H/V38D/Y40H/V41R/L97bA/H99Q/C122S/M157K | 87.3 |
| 544 | F30Y/V38D/Y40L/V41Q/L97bA/H99Q/C122S/Y151L/M157R/Q192Y | 88.1 |
| 228 | F30Y/R35Q/H37W/V38D/Y40H/V41R/Y60bN/L97bA/H99Q/C122S/Y149R/M157K | 88.8 |
| 826 | V38D/V41Q/Y60bR/T97aW/L97bR/H99E/C122S/Y151L/E175D/Q192T/R217E/K224R | 90 |
| 985 | R37aH/V38E/T39Y/V41R/D60aP/Y60bQ/L97bA/H99Q/C122S | 90.7 |
| 547 | F30H/V38D/V41Q/L97bA/H99Q/C122S/Y151L/M157R | 91.3 |
| 886 | V38D/T39Y/Y40L/V41K/L97bR/H99L/C122S/E175D | 91.8 |
| 944 | R37aD/V38E/Y40Q/V41L/Y60bP/T97aE/L97bA/H99Q/C122S/Y149R | 91.9 |
| 32 | R35Q/H37Y/R37aE/V38E/T39Y/V41R/D60aP/Y60bQ/T97aI/L97bA/C122S/Y149R | 92.3 |
| 542 | N26D/F30Y/V38D/Y40H/V41R/I65T/L97bA/H99Q/C122S/M126I/M157K | 93.2 |
| 946 | R35A/R37aD/V38E/Y40Q/V41L/Y60bV/T97aE/L97bA/H99Q/C122S/Y149K | 93.4 |
| 939 | R35S/R37aD/V38E/Y40Q/V41L/Y60bT/T97aE/L97bA/H99Q/C122S/Y149R | 93.5 |
| 508 | F30H/R35Q/H37T/V38D/V41R/L97bA/H99Q/C122S/Y149I/Y151L/M157K/R217D | 93.6 |
| 541 | F30H/V38D/L97bA/H99Q/C122S/Y151L/M157K | 94.2 |
| 377 | V38D/H99Q/C122S/Y151L/R217V | 94.4 |
| 576 | F30Y/R35T/H37T/V38D/Y40H/V41R/D60aP/Y60bD/L97bA/H99Q/C122S/Y149T/M157K | 94.7 |
| 227 | I17V/F30Y/V38D/Y40H/V41R/L97bA/H99Q/C122S/Y149R/M157K | 94.8 |
| 855 | V38D/V41R/Y60bR/L97bR/H99L/C122S/Y151L/E175D/Q192Y/R217E/K224R | 94.9 |
| 372 | R37aE/V38E/Y40Q/V41L/Y60bS/T97aE/L97bA/H99Q/C122S/Y149R | 95 |
| 594 | F30Y/R36H/H37E/V38E/T39Y/Y40H/V41R/Y60bN/T97aV/L97bA/H99Q/C122S/Y149K/M157K | 96.3 |
| 820 | V38D/V41Q/D60aP/Y60bS/T97aS/L97bR/H99E/C122S/Y151L/E175D/Q192Y/R217E/K224R | 96.4 |
| 510 | F30H/R35Q/H37Q/V38D/V41R/A96D/L97bA/H99Q/C122S/Y149L/Y151L/M157K/R217D | 96.8 |
| 240 | F30Y/R35Q/H37Y/V38D/Y40H/V41R/Y60bE/L97bA/H99Q/C122S/Y149R/M157K | 98.7 |
| 891 | H37A/R37aE/V38F/T39L/V41Q/Y60bR/T97aW/L97bR/H99E/C122S/Y151L/E175D/Q192T/R217E/K224R | 99.6 |
| 605 | F30Y/R36H/V38E/T39V/Y40H/V41R/Y60bH/T97aE/L97bA/H99Q/C122S/Y149S/M157K | 99.7 |
| 485 | F30Y/V38D/Y40H/V41R/L97bA/H99Q/C122S | 99.9 |
| 622 | F30Y/R35V/R36H/H37S/V38E/T39F/Y40H/V41R/Y60bS/T97aI/L97bA/H99Q/C122S/Y149R/M157K/Q192T | 100 |
| 585 | F30Y/R36H/V38E/Y40H/V41R/Y60bN/N87D/A96T/T97aI/L97bA/H99Q/C122S/N145S/M157K/M207K | 101 |

TABLE 14-continued

| SEQ ID NO* | Mutation String | ED50 (nM) |
|---|---|---|
| 309 | V38E/Y40Q/V41L/L97bA/C122S | 101 |
| 952 | R37aS/V38E/V41R/L97bG/H99Q/C122S/R217V | 101 |
| 445 | R36H/V38D/Y40L/V41K/D97E/A98G/T97adel/H99L/L97bdel/C122S/Y151L/Q192T/R217D | 102 |
| 649 | F30Y/R35Q/R36H/H37G/V38E/T39H/Y40F/V41R/T97aI/L97bA/H99Q/C122S/Y149R/M157K/Q192M | 102 |
| 363 | R35V/R37aE/Y40Q/Y60bS/T97aE/L97bA/H99Q/C122S/Y149R | 103 |
| 314 | V38D/T39L/Y40L/T97aI/L97bA/H99Q/C122S | 104 |
| 183 | F30Y/V38D/Y40H/V41R/L97bA/H99Q/C122S/M157K/R217E | 105 |
| 655 | F30L/R35L/R36H/H37T/V38E/T39Y/V41K/T97aI/L97bA/H99Q/C122S/Y149R/M157K | 105 |
| 921 | R36S/V38D/T39A/Y40F/V41R/L97bA/H99E/C122S/R217T | 105 |
| 568 | F30Y/R35K/H37E/V38D/Y40H/V41R/D60aP/Y60bD/L97bA/H99Q/C122S/Y149N/M157K | 106 |
| 691 | F30Y/R35L/R36H/H37E/V38E/T39S/Y40F/V41R/T97aI/L97bA/H99Q/C122S/Y149R/M157K | 106 |
| 739 | R35Q/H37T/R37aP/V38E/T39Y/V41R/D60aE/Y60bD/T97aI/L97bA/H99Q/C122S/Y149R | 106 |
| 448 | R36H/V38D/Y40I/V41K/D97E/A98G/T97adel/H99L/L97bdel/C122S/Q192A/R217D | 107 |
| 540 | F30Y/R36H/V38D/Y40H/V41R/L97bA/H99Q/C122S/M157K/T210S | 107 |
| 397 | T39Y/V41R/Y60bQ/L97bA/C122S | 108 |
| 208 | F30Y/R35Q/H37T/V38D/Y40H/V41R/L97bA/H99Q/C122S/Y149W/M157K | 109 |
| 211 | F30Y/V38D/Y40H/V41R/T56A/L97bA/H99Q/C122S/M157K | 109 |
| 546 | F30Y/R36S/V38D/Y40H/V41R/L97bA/H99Q/C122S/M157K | 109 |
| 850 | V38D/V41R/D60aP/Y60bD/T97aW/L97bR/H99Q/C122S/Y151L/E175D/Q192A/R217E/K224R | 109 |
| 842 | V38D/V41R/Y60bN/T97aL/L97bR/H99E/C122S/Y151L/E175D/Q192T/R217E/K224R | 109 |
| 883 | R35H/V38D/V41Q/L97bR/H99Q/C122S/Y151L/R217V | 109 |
| 967 | R35H/V38E/L97bR/C122S/Y151L/R217V | 109 |
| 447 | R36H/V38D/V41R/D97E/A98G/T97adel/H99L/L97bdel/C122S/Y151L/Q192G/R217D | 110 |
| 254 | F30Y/R35W/R36H/H37E/V38E/T39W/Y40H/V41R/Y60bH/T97aI/L97bA/H99Q/C122S/Y149R/M157K/Q192A | 111 |
| 385 | R37aS/V41R/L97bG/H99Q/C122S/R217V | 111 |
| 887 | R35Q/H37G/R37aN/V38F/T39H/V41Q/Y60bR/T97aL/L97bR/H99E/C122S/Y151L/E175D/Q192T/R217E/K224R | 112 |
| 164 | R36S/V38D/V41R/A96D/D97G/A98G/T97adel/H99L/L97bdel/C122S/M157K/R217D | 113 |
| 210 | F30Y/R35Q/H37T/V38D/Y40H/V41R/L97bA/H99Q/C122S/M157K | 113 |
| 838 | R35S/V38D/Y40Q/V41R/Y60bS/L97bG/H99Q/C122S | 113 |
| 898 | H37S/R37aD/V38H/T39L/V41Q/Y60bR/T97aW/L97bR/H99E/C122S/Y151L/E175D/Q192T/R217E/K224R | 113 |
| 196 | F30Y/V38D/Y40H/V41R/L97bA/H99Q/C122S/Y149F/M157K | 114 |
| 310 | Y40Q/L97bA/H99Q/C122S | 114 |
| 355 | R37aE/Y40Q/V41L/Y60bE/L97bA/H99Q/C122S/Y149R | 114 |
| 945 | R35S/R37aD/V38E/Y40L/T97aD/L97bA/H99Q/C122S/Y149K | 115 |
| 643 | R35Q/H37M/V38D/T39V/V41R/Y60bP/L97bA/H99Q/C122S/Y149R | 116 |
| 644 | R35L/H37E/V38D/T39Y/V41R/L97bA/H99Q/C122S/Y149R | 116 |
| 450 | R36H/V38D/Y40L/V41R/D97E/A98G/T97adel/H99L/L97bdel/C122S/Y151L/Q192D/R217D | 118 |
| 497 | F30Y/Y34N/V38D/Y40H/V41R/Y94F/S95R/L97bA/H99Q/C122S/M157K/T242I | 118 |
| 323 | R37aD/G37bD/V38F/T39H/V41R/Y60bK/T97aS/L97bR/H99E/C122S/Y151L/E175D/Q192T/R217E/K224R | 118 |
| 334 | H37G/R37aD/G37bD/V38F/T39H/V41R/Y60bK/T97aS/L97bR/H99E/C122S/Y151L/Q192T/R217E/K224R | 118 |
| 392 | Y40H/V41T/L97bG/H99Q/C122S | 118 |
| 8 | F30Y/V38D/Y40H/V41R/L97bA/H99Q/C122S/M157K | 119 |
| 434 | R37aH/V38D/V41R/A96D/D97G/A98G/T97adel/H99L/L97bdel/C122S/Y151L/Q192G/R217D | 119 |
| 419 | R36H/V38D/V41M/D97E/A98G/T97adel/H99L/L97bdel/C122S/R217D | 120 |
| 317 | V38D/L97bR/H99Q/C122S/Y151L/R217V | 120 |
| 201 | F30Y/R35Q/V38D/Y40H/V41R/L97bA/H99Q/C122S/Y149W/M157K | 121 |
| 549 | F30Y/R37aH/V38D/Y40H/V41R/K61E/L97bA/H99Q/C122S/M157K | 121 |
| 767 | V38D/L97bR/H99E/C122S/E175D/K224S | 121 |
| 888 | H37N/R37aD/V38Y/T39F/V41Q/Y60bR/T97aW/L97bR/H99E/C122S/Y151L/E175D/Q192T/R217E/K224R | 121 |
| 452 | R36H/V38D/Y40L/V41R/D97E/A98G/T97adel/H99L/L97bdel/C122S/Q192R/R217D | 122 |
| 560 | F30Y/R37aS/V38D/Y40H/V41R/L97bA/H99Q/C122S/M157K | 122 |
| 837 | V38D/V41R/L97bG/H99Q/C122S/Y151L/Q192S/R217A | 122 |
| 361 | R37aD/Y40Q/V41L/Y60bE/L97bA/H99Q/C122S/Y149R | 122 |
| 880 | R35S/V38D/V41T/L97bR/H99Q/C122S/Y151L/R217E | 124 |
| 40 | Y40Q/V41L/L97bA/C122S | 124 |
| 173 | F30H/V38D/V41R/L97bV/H99Q/C122S/Y151L/M157K | 125 |
| 229 | F30Y/V38D/Y40H/V41R/L97bA/H99Q/C122S/Y149R/M157K | 125 |
| 322 | V38D/V41R/L97bR/H99Q/C122S/Y151L | 125 |
| 895 | H37A/R37aE/V38Y/T39Y/V41Q/Y60bR/T97aV/L97bR/H99E/C122S/Y151L/E175D/Q192T/R217E/K224R | 126 |
| 892 | H37N/R37aE/V38F/T39L/V41Q/Y60bR/T97aW/L97bR/H99E/C122S/Y151L/E175D/Q192T/R217E/K224R | 127 |

TABLE 14-continued

| SEQ ID NO* | Mutation String | ED50 (nM) |
|---|---|---|
| 652 | F30Y/R35L/R36H/H37E/V38E/T39L/Y40F/V41R/T97aI/L97bA/H99Q/C122S/Y149R/M157K/Q192H | 129 |
| 451 | R36H/V38D/Y40L/V41R/D97E/A98G/T97adel/H99L/L97bdel/C122S/Y151M/Q192T/R217D | 130 |
| 854 | V38D/V41R/Y60bR/L97bR/H99L/C122S/Y151L/E175D/Q192T/R217E/K224R | 130 |
| 308 | V38E/Y40Q/L97bA/H99Q/C122S | 133 |
| 968 | V38E/T56I/H99Q/C122S/Y151L/S190G/R217V | 134 |
| 556 | F30Y/S37dP/V38D/Y40H/V41R/L97bA/H99Q/C122S/M157K | 135 |
| 964 | R35S/V38E/L97bR/C122S/Y151L/R217V/H241N | 135 |
| 396 | T39Y/V41R/L97bA/C122S | 135 |
| 384 | L97bR/C122S/Y151L/R217V | 136 |
| 599 | F30Y/R35L/R36H/H37E/V38E/T39L/Y40H/V41R/Y60bS/T97aD/L97bA/H99Q/C122S/Y149R/M157K | 137 |
| 596 | F30Y/R36H/H37E/V38E/T39W/Y40H/V41R/Y60bD/T97aD/L97bA/H99Q/C122S/Y149R/M157K | 137 |
| 894 | R35K/H37S/R37aE/V38F/T39Y/V41Q/Y60bR/T97aL/L97bR/H99E/C122S/Y151L/E175D/Q192T/R217E/K224R | 141 |
| 269 | F30Y/R35W/R36H/H37E/V38E/T39W/Y40H/V41R/Y60bQ/T97aE/L97bA/H99L/C122S/Y149K/M157K | 142 |
| 840 | R35Q/V38D/Y40L/V41L/Y60bP/L97bG/H99Q/C122S | 142 |
| 471 | F30H/V38D/V41R/L97bA/H99Q/C122S/M157E | 146 |
| 429 | V38D/V41R/A96D/D97G/A98G/T97adel/H99L/L97bdel/C122S/Y151L/Q192D/R217D | 146 |
| 501 | F30Y/R36S/V38H/Y40L/V41R/N76K/L97bA/H99Q/C122S/M157K | 146 |
| 195 | F30Y/V38D/Y40H/V41R/L97bA/H99Q/C122S/Y149L/M157K | 147 |
| 539 | F30H/V38D/Y40F/V41R/L97bA/H99Q/C122S/Y151L/M157R/Q192H | 149 |
| 927 | R37aP/V38D/T39L/Y40I/V41R/H99L/C122S/R217Q | 150 |
| 293 | V38E/V41R/T97aI/L97bA/H99Q/C122S | 152 |
| 375 | R35V/R37aE/V38E/Y40Q/Y60bS/T97aE/L97bA/H99Q/C122S/Y149R | 153 |
| 214 | V38D/V41R/L97bA/H99Q/C122S/M157K/T158A | 154 |
| 189 | F30Y/V38D/Y40H/V41R/L97bA/H99Q/C122S/Y149F/M157K/R217E | 155 |
| 31 | R35Q/H37Y/R37aE/V38E/T39Y/V41R/D60aP/Y60bQ/T97aI/H99Q/C122S/Y149R | 155 |
| 393 | V41R/L97bG/H99Q/C122S | 155 |
| 890 | R35K/H37G/R37aE/G37bS/V38F/T39H/V41Q/Y60bR/T97aW/L97bR/H99E/C122S/Y151L/E175D/Q192T/R217E/K224R | 156 |
| 571 | F30Y/R35S/H37G/V38D/Y40H/V41R/D60aP/Y60bE/L97bA/H99Q/C122S/Y149K/M157K | 158 |
| 602 | F30Y/R36H/H37D/V38E/T39Y/Y40H/V41R/Y60bM/T97aD/L97bA/H99Q/C122S/Y149R/M157K | 159 |
| 203 | F30Y/R35Q/V38D/Y40H/V41R/L97bA/H99Q/C122S/M157K | 160 |
| 843 | V38D/V41Q/Y60bR/T97aF/L97bR/H99Q/C122S/Y151L/E175D/Q192H/R217E/K224R | 160 |
| 897 | H37A/R37aD/V38Y/T39Y/V41Q/Y60bR/T97aD/L97bR/H99E/C122S/Y151L/E175D/Q192T/R217E/K224R | 160 |
| 896 | H37D/R37aD/V38Y/T39Y/V41Q/Y60bR/T97aL/L97bR/H99E/C122S/Y151L/E175D/Q192T/R217E/K224R | 162 |
| 353 | Y40Q/V41L/L97bA/C122S/Y149R | 162 |
| 488 | F30H/V38D/V41R/L97bA/H99Q/C122S/Y149N/Y151L/M157K/R239H | 163 |
| 930 | R36S/V38D/T39S/V41R/L97bI/H99E/C122S/R217T | 163 |
| 906 | V38D/T39V/V41R/L97bV/H99E/C122S/R217E | 165 |
| 962 | R37aS/V38E/Y40Q/V41L/L97bG/C122S/Y151P/R217T | 166 |
| 484 | F30H/V38D/V41R/L97bA/H99Q/C122S/Y151L/M157K | 167 |
| 378 | V38D/L97bR/C122S/Y151L/R217V | 170 |
| 593 | F30Y/R36H/H37P/V38E/T39Y/Y40H/V41R/Y60bN/L97bA/H99Q/C122S/Y149R/M157K | 171 |
| 825 | V38D/V41K/D60aN/Y60bN/L97bR/H99E/C122S/Y151L/E175D/Q192H/R217E/K224R | 172 |
| 889 | H37A/R37aE/V38F/T39L/V41Q/Y60bR/T97aF/L97bR/H99E/C122S/Y151L/E175D/Q192T/R217E/K224R | 174 |
| 345 | Y40Q/V41L/H99Q/C122S | 174 |
| 574 | F30Y/R35Q/V38D/Y40H/V41R/Y60bS/L97bA/H99Q/C122S/Y149R/M157K/R217E | 175 |
| 730 | F30Y/R36H/H37D/R37aE/V38E/T39Y/Y40F/V41R/Y60bN/T97aE/L97bA/H99Q/C122S/Y149R/M157K | 176 |
| 941 | R35K/R37aD/V38E/Y40Q/V41L/Y60bE/L97bA/H99Q/C122S/Y149R | 178 |
| 209 | F30Y/R35Q/H37T/V38D/Y40H/V41R/L97bA/H99Q/C122S/Y149F/M157K | 179 |
| 321 | V38D/T39L/Y40L/V41R/T97aI/L97bA/C122S | 179 |
| 245 | N26D/F30Y/R36H/R37aH/V38E/Y40H/V41R/K61E/I65T/L97bA/H99Q/C122S/M126I/M157K | 185 |
| 367 | R35V/R37aE/V38E/Y40Q/V41L/Y60bS/T97aE/L97bA/C122S/Y149R | 185 |
| 483 | F30Y/V38D/Y40M/V41R/L97bA/H99Q/C122S | 188 |
| 768 | V38D/L97bV/H99E/C122S/K224S | 192 |
| 861 | V38D/V41R/D60aQ/Y60bP/L97bG/H99Q/C122S | 192 |
| 202 | F30Y/R35Q/V38D/Y40H/V41R/L97bA/H99Q/C122S/Y149F/M157K | 194 |
| 931 | R37aS/V38D/T39G/V41R/L97bM/H99E/C122S/R217S | 194 |
| 521 | F30Y/R35Q/H37T/V38D/Y40H/V41R/L97bA/H99Q/C122S/Y149I/M157K | 196 |
| 473 | F30Y/V38D/Y40H/V41A/L97bA/H99Q/C122S/M157R | 197 |
| 191 | F30Y/R35Q/V38D/Y40H/V41R/L97bA/H99Q/C122S/Y149L/M157K/R217E | 199 |
| 206 | F30Y/H37T/V38D/Y40H/V41R/L97bA/H99Q/C122S/M157K | 199 |
| 327 | H37G/R37aD/G37bD/V38F/V41R/Y60bK/T97aS/L97bR/H99E/C122S/Y151L/E175D/Q192T/R217E/K224R | 199 |

TABLE 14-continued

| SEQ ID NO* | Mutation String | ED50 (nM) |
|---|---|---|
| 41 | R37aS/V41R/L97bG/H99Q/C122S | 199 |
| 244 | F30Y/R36H/V38E/Y40H/V41R/T97aI/L97bA/H99Q/C122S/M157K/Q192H | 201 |
| 248 | N26D/F30Y/V38D/Y40H/V41R/I65T/L97bA/H99Q/C122S/M126I/Y149R/M157K | 201 |
| 864 | R35K/V38D/Y40H/Y60bP/L97bG/H99Q/C122S | 201 |
| 525 | F30Y/R35Q/V38D/Y40H/V41R/L97bA/H99Q/C122S/E153D/M157K | 202 |
| 526 | F30Y/V38D/Y40H/V41R/L97bA/H99Q/C122S/D148N/M157K/T188S | 202 |
| 660 | R35E/R36H/H37D/V38E/T39W/Y40F/V41R/T97aI/L97bA/H99Q/C122S/Y149R/ M157K/Q192T | 202 |
| 558 | F30Y/R37aS/V38D/Y40H/V41R/E86D/L97bA/H99Q/C122S/M157K/F234Y | 203 |
| 723 | F30Y/R35Q/R36H/H37D/R37aE/V38E/T39Y/Y40F/V41R/D60aE/Y60bG/T97aE/L97bA/ H99Q/C122S/Y149R/M157K | 203 |
| 563 | F30Y/R37aS/V38D/Y40H/V41R/L97bA/H99Q/C122S/M157K/K187Q/T208S | 205 |
| 465 | R36H/V38D/V41R/A96D/D97G/T97aN/A98G/L97bdel/H99L/C122S/Q192R/R217F | 208 |
| 170 | F30Y/V38D/Y40H/V41R/L97bA/H99Q/C122S/M157K/R217D | 208 |
| 583 | F30Y/R35T/H37T/V38D/Y40H/V41R/D60aT/Y60bS/L97bA/H99Q/C122S/Y149K/ M157K | 208 |
| 609 | F30Y/R35L/H37D/V38D/Y40H/V41R/D60aE/Y60bT/L97bA/H99Q/C122S/Y149R/ M157K | 212 |
| 352 | R37aE/Y40Q/V41L/L97bA/C122S | 212 |
| 920 | R36S/V38D/T39K/Y40F/V41R/L97bI/H99E/C122S/R217S | 213 |
| 320 | V38D/T39L/Y40L/V41K/L97bR/H99L/C122S/E175D | 215 |
| 169 | V38D/V41R/A96E/D97G/A98G/T97adel/H99L/L97bdel/C122S/Y151L/T178S/Q192E/ R217D | 217 |
| 588 | F30Y/R37aP/V38D/Y40H/V41R/Y60bN/E84D/L97bA/H99Q/C122S/M157K/T242I | 219 |
| 190 | F30Y/V38D/Y40H/V41R/L97bA/H99Q/C122S/Y149F/M157K/R217D | 222 |
| 566 | F30Y/R35T/H37Q/V38D/Y40H/V41R/D60aE/Y60bN/L97bA/H99Q/C122S/Y149R/ M157K | 230 |
| 536 | R37aL/V38D/L97bA/H99Q/C122S/Y151L/M157S | 231 |
| 760 | V38D/L97bR/H99E/C122S/E175D/R217E/K224R | 234 |
| 478 | F30Y/V38D/Y40L/V41R/L97bA/H99Q/C122S/M157R | 235 |
| 238 | F30Y/R35Q/V38D/Y40H/V41R/D60aE/Y60bS/L97bA/H99Q/C122S/Y149T/M157K | 235 |
| 234 | F30Y/R35Q/H37D/V38D/Y40H/V41R/D60aE/Y60bN/L97bA/H99Q/C122S/Y149S/ M157K | 236 |
| 207 | F30Y/R35Q/H37T/V38D/Y40H/V41R/L97bA/H99Q/C122S/Y149L/M157K | 238 |
| 344 | Y40Q/V41L/C122S | 238 |
| 554 | F30Y/Y34S/R37aH/V38D/Y40H/V41R/L97bA/H99Q/C122S/Y149F/M157K | 239 |
| 354 | R37aE/Y40Q/V41L/L97bA/C122S/Y149R | 245 |
| 247 | N26D/F30Y/V38D/Y40L/V41R/I65T/L97bA/H99Q/C122S/M126I/M157K | 247 |
| 476 | F30Y/V38D/Y40H/V41N/L97bA/H99Q/C122S | 250 |
| 524 | F30Y/R35H/V38D/Y40H/V41R/T56A/L97bV/H99Q/R116S/C122S/M157K/T210N | 250 |
| 212 | F30Y/V38D/Y40H/V41R/L97bA/H99Q/C122S/Y151F/M157K | 252 |
| 388 | Y40H/V41Q/L97bG/C122S/R217T | 252 |
| 974 | V38E/T39H/D60aP/Y60bK/L97bG/H99Q/C122S | 252 |
| 205 | F30Y/H37T/V38D/Y40H/V41R/L97bA/H99Q/C122S/Y149F/M157K | 255 |
| 167 | V38D/Y40P/V41K/L97bA/H99Q/C122S | 257 |
| 573 | F30Y/R35T/H37A/V38D/Y40H/V41R/D60aP/Y60bE/L97bA/H99Q/C122S/Y149K/ M157K/R217Y | 263 |
| 559 | F30Y/R37aH/V38D/Y40H/V41R/L97bA/H99Q/C122S/M157K/S174P | 267 |
| 569 | F30Y/R35L/H37D/V38D/Y40H/V41R/Y60bD/L97bA/H99Q/C122S/Y149R/M157K | 267 |
| 578 | F30Y/R35S/V38D/Y40H/V41R/D60aE/Y60bS/L97bA/H99Q/C122S/Y149R/M157K | 270 |
| 383 | L97bR/H99Q/C122S/Y151L | 271 |
| 572 | F30Y/R35Q/V38D/Y40H/V41R/D60aE/Y60bE/L97bA/H99Q/C122S/Y149N/M157K | 275 |
| 200 | F30Y/R35Q/V38D/Y40H/V41R/L97bA/H99Q/C122S/Y149L/M157K | 276 |
| 250 | F30Y/V38D/Y40L/V41R/L97bA/H99Q/C122S/M157K | 277 |
| 567 | F30Y/R35T/V38D/Y40H/V41R/D60aE/Y60bQ/L97bA/H99Q/C122S/Y149R/M157K/ R217K | 277 |
| 477 | F30S/V38D/V41R/L97bA/H99Q/C122S/Y151L/M157K | 279 |
| 819 | V38D/V41Q/D60aK/Y60bD/T97aA/L97bR/H99E/C122S/Y151L/E175D/Q192Y/R217E/ K224R | 279 |
| 186 | F30Y/V38D/Y40H/V41R/L97bA/H99Q/C122S/Y149L/M157K/R217E | 280 |
| 976 | V38E/T39H/D60aP/Y60bW/L97bG/H99Q/C122S | 281 |
| 662 | F30H/R35L/R36H/H37D/V38E/T39Y/Y40F/V41Q/T97aI/L97bA/H99Q/C122S/Y149R/ M157K | 284 |
| 316 | V38D/T39L/Y40L/V41R/T97aI/H99Q/C122S | 284 |
| 757 | V38D/L97bR/H99Q/C122S/E175D/R217E/K224R | 292 |
| 923 | R37aS/V38D/T39L/Y40L/V41R/L97bM/H99L/C122S/R217S | 292 |
| 654 | F30Y/R36H/V38E/Y40H/V41R/T97aI/L97bA/H99Q/C122S/Y149R/M157K/Q192Y | 297 |
| 637 | R35E/H37D/V38D/T39N/V41R/Y60bN/L97bA/H99Q/C122S/Y149R | 306 |
| 766 | V38D/L97bR/H99E/C122S/E175D/K224A | 306 |
| 763 | V38D/L97bV/H99L/C122S/E175D/K224S | 310 |
| 813 | V38D/L97bR/H99L/C122S/E175D/K224A | 310 |
| 912 | R37aP/V38D/T39Y/V41R/L97bV/H99Q/C122S/R217T | 316 |
| 175 | F30H/V38D/V41R/L97bA/H99Q/C122S/Y151M/M157K | 321 |
| 502 | F30H/V38D/V41R/L73Q/L97bA/H99Q/E110bD/C122S/Y149N/Y151L/M157K | 321 |
| 582 | F30Y/R35Q/V38D/Y40H/V41R/D60aE/Y60bN/L97bA/H99Q/C122S/Y149R/M157K | 324 |
| 817 | V38D/L97bT/H99E/C122S/E175D/K224S | 326 |
| 204 | F30Y/H37T/V38D/Y40H/V41R/L97bA/H99Q/C122S/Y149L/M157K | 330 |

TABLE 14-continued

| SEQ ID NO* | Mutation String | ED50 (nM) |
|---|---|---|
| 522 | F30Y/R35Q/H37T/V38D/Y40H/V41R/D60aE/Y60bN/L97bA/H99Q/C122S/Y149H/M157K | 331 |
| 589 | F30Y/R37aP/G37bD/V38D/Y40H/V41R/Y60bN/L97bA/H99Q/C122S/M157K | 331 |
| 237 | F30Y/R35Q/V38Y/Y40H/V41R/D60aE/Y60bE/L97bA/H99Q/C122S/Y149V/M157K/R217M | 332 |
| 764 | V38D/L97bR/H99L/C122S/E175D/R217E | 333 |
| 235 | F30Y/R35Q/H37T/V38D/Y40H/V41R/D60aE/Y60bN/L97bA/H99Q/C122S/Y149L/M157K | 338 |
| 773 | V38D/L97bG/H99Q/C122S/R217Q | 338 |
| 187 | F30Y/V38D/Y40H/V41R/L97bA/H99Q/C122S/Y149L/M157K/R217D | 341 |
| 933 | R35E/R37aD/V38E/Y40Q/V41L/Y60bN/L97bA/H99Q/C122S/Y149R | 342 |
| 610 | F30Y/R35Q/V38D/Y40H/V41R/D60aK/Y60bV/L97bA/H99Q/C122S/Y149R/M157K | 344 |
| 581 | F30Y/R35Q/V38D/Y40H/V41R/D60aP/Y60bE/L97bA/H99Q/C122S/Y149R/M157K/R217K | 345 |
| 865 | R35Q/V38D/Y40M/V41R/Y60bA/L97bG/H99Q/C122S | 345 |
| 252 | F30Y/R36H/V38E/Y40L/V41R/T97aI/L97bA/H99Q/C122S/M157K/Q192H | 346 |
| 331 | H37G/R37aD/G37bD/V38F/T39H/V41R/Y60bK/T97aS/H99E/C122S/Y151L/E175D/Q192T/R217E/K224R | 347 |
| 26 | R35Q/H37Y/R37aE/V38E/V41R/D60aP/Y60bQ/T97aI/L97bA/H99Q/C122S/Y149R | 348 |
| 866 | R35K/V38D/Y40F/V41R/Y60bT/L97bG/H99Q/C122S | 348 |
| 579 | F30Y/R35H/H37T/V38D/Y40H/V41R/D60aR/Y60bD/L97bA/H99Q/C122S/Y149R/M157K | 349 |
| 774 | F30H/V38D/L97bA/H99Q/C122S/Y151L/M157T/Q192H | 349 |
| 380 | L97bR/H99Q/C122S/Y151L/R217V | 351 |
| 860 | R35S/V38D/V41L/D60aP/Y60bW/L97bG/H99Q/C122S | 353 |
| 391 | Y40H/V41T/L97bG/C122S/R217T | 357 |
| 301 | V38E/V41L/Y60bL/L97bA/H99Q/C122S | 364 |
| 815 | V38D/L97bK/H99L/C122S/E175D/K224A | 365 |
| 302 | L97bG/H99Q/C122S/R217Q | 367 |
| 646 | R35G/H37G/V38D/T39W/V41A/Y60bN/L97bA/H99Q/C122S | 370 |
| 636 | R35F/H37G/V38D/T39H/V41A/Y60bD/L97bA/H99Q/C122S/Y149R | 371 |
| 332 | H37G/R37aD/G37bD/V38F/T39H/V41R/Y60bK/T97aS/L97bR/C122S/Y151L/E175D/Q192T/R217E/K224R | 371 |
| 193 | F30Y/H37D/V38D/Y40H/V41R/L97bA/H99Q/C122S/Y149L/M157K/R217E | 378 |
| 862 | R35Q/V38D/Y40H/V41L/Y60bD/L97bG/H99Q/C122S | 380 |
| 828 | V38D/V41Q/L97bG/H99Q/C122S/Y151L/Q192S/R217A | 385 |
| 965 | R35S/V38E/H99Q/C122S/S146F/Y151L/V159L/K179N/Q192R/R217V/T242S | 408 |
| 590 | F30Y/R35L/R36H/H37P/V38E/Y40H/V41R/Y60bG/T97aD/L97bA/H99Q/C122S/Y149R/M157K | 409 |
| 971 | V38E/T39R/D60aP/Y60bD/L97bG/H99Q/C122S | 412 |
| 846 | R37aS/V38D/V41R/Y60bT/T97aD/L97bR/H99Q/C122S/Y151L/E175D/Q192A/R217E/K224R | 413 |
| 318 | V38D/V41R/L97bR/H99Q/C122S/R217V | 418 |
| 438 | R36H/V38D/Y40F/V41R/D97E/A98G/T97adel/H99L/L97bdel/C122S/Y151L/Q192D/R217D | 421 |
| 537 | F30N/V38D/V41L/L97bA/H99Q/C122S/Y151L/M157R | 428 |
| 899 | H37G/R37aD/V38Y/T39H/V41Q/Y60bR/T97aD/L97bR/H99E/C122S/Y151L/E175D/Q192T/R217E/K224R | 433 |
| 659 | F30Y/R35W/R36H/H37E/V38E/T39S/Y40L/V41R/T97aI/L97bA/H99Q/C122S/Y149R/M157K/Q192A | 434 |
| 844 | V38D/V41R/D60aP/Y60bD/T97aP/L97bR/H99Q/C122S/Y151L/E175D/Q192R/R217E/K224R | 437 |
| 460 | F30Y/R36H/V38D/V41K/D97E/T97adel/A98G/L97bdel/H99L/C122S/R217D | 445 |
| 274 | L97bA/H99Q/C122S | 449 |
| 966 | F30Y/R37aH/V38E/H99Q/C122S/Y151L/R217V | 449 |
| 246 | N26D/F30Y/V38D/Y40H/V41R/I65T/L97bA/H99Q/C122S/M126I/M157K/Q192H | 455 |
| 253 | F30Y/R35W/R36H/H37E/V38E/T39S/Y40H/V41W/Y60bW/T97aI/L97bA/H99Q/C122S/Y149R/M157K/Q192Y | 463 |
| 970 | V38E/T39S/V41L/Y60bP/L97bG/H99Q/C122S | 464 |
| 319 | V38D/Y40L/V41K/L97bR/H99L/C122S/E175D | 466 |
| 236 | F30Y/R35Q/V38D/Y40H/V41R/Y60bE/L97bA/H99Q/C122S/Y149Q/M157K/R217S | 470 |
| 297 | V38D/L97bR/H99E/C122S/E175D/R217E | 470 |
| 343 | V41L/L97bA/H99Q/C122S | 471 |
| 366 | R35V/R37aE/V38E/Y40Q/V41L/Y60bS/T97aE/H99Q/C122S/Y149R | 478 |
| 640 | R35F/H37E/V38D/T39S/V41A/Y60bD/L97bA/H99Q/C122S | 487 |
| 333 | H37G/R37aD/G37bD/V38F/T39H/V41R/Y60bK/T97aS/L97bR/H99E/C122S/E175D/Q192T/R217E/K224R | 499 |
| 213 | V38D/L97bA/H99Q/C122S/M157K/T158A | 503 |
| 256 | F30Y/R35W/R36H/H37E/V38E/T39R/Y40H/V41W/Y60bW/T97aI/L97bA/H99Q/C122S/Y149R/M157K/Q192Y | 511 |
| 529 | F30H/V38D/L97bA/H99Q/C122S/Y151L/M157L/Q192H | 515 |
| 492 | F30Y/R37aH/V38D/Y40L/V41R/L97bA/H99Q/C122S/M157K | 516 |
| 239 | F30Y/R35Q/V38D/Y40H/V41R/D60aE/Y60bE/L97bA/H99Q/C122S/Y149L/M157K/R217S | 530 |
| 814 | V38D/L97bM/H99S/C122S/K224S | 538 |
| 575 | F30Y/R37aD/V38D/Y40L/V41R/L97bA/H99Q/C122S/M126K/M157K | 539 |
| 394 | V41Q/L97bG/H99Q/C122S | 547 |

TABLE 14-continued

| SEQ ID NO* | Mutation String | ED50 (nM) |
|---|---|---|
| 435 | V38D/Y40P/V41R/A96D/D97G/A98G/T97adel/H99L/L97bdel/C122S/Q192L/R217D | 557 |
| 258 | F30Y/R35Y/R36H/H37E/V38E/T39R/Y40H/V41W/Y60bW/T97aI/L97bA/H99Q/C122S/Y149R/M157K/Q192H | 569 |
| 908 | R36S/V38D/T39H/Y40L/V41R/L97bV/H99V/C122S/R217Q | 574 |
| 638 | R35Q/H37Y/V38D/T39A/V41R/Y60bP/L97bA/H99Q/C122S/Y149R/Q192S | 575 |
| 845 | V38D/V41Q/Y60bP/T97aW/L97bR/H99Q/C122S/Y151L/E175D/Q192K/R217E/K224R | 578 |
| 907 | R37aH/V38D/T39M/Y40A/V41K/L97bR/H99Q/C122S/R217E | 582 |
| 328 | H37G/R37aD/G37bD/V38F/T39H/Y60bK/T97aS/L97bR/H99E/C122S/Y151L/E175D/Q192T/R217E/K224R | 594 |
| 811 | V38D/L97bR/H99L/C122S/E175D/R217E/K224R | 610 |
| 848 | R37aS/V38D/V41R/D60aS/Y60bP/L97bR/H99Q/C122S/Y151L/E175D/Q192R/R217E/K224R | 614 |
| 570 | F30Y/R35H/H37T/V38D/Y40H/V41R/D60aE/Y60bD/L97bA/H99Q/C122S/Y149K/M157K/R217K | 622 |
| 295 | V38E/T97aI/L97bA/H99Q/C122S | 630 |
| 499 | F30Y/R35H/V38D/T39S/Y40H/V41R/S75P/L97bA/H99Q/C122S/M157K/I163M/Q204H/K243E | 632 |
| 528 | F30Y/V38D/Y40M/V41R/L97bA/H99Q/C122S/Y151L/M157R/Q192M | 641 |
| 395 | V41T/L97bG/H99Q/C122S | 646 |
| 463 | R36H/V38D/V41M/A55S/D97E/A98G/T97adel/H99L/L97bdel/C122S/R217D | 647 |
| 928 | V38D/T39V/Y40L/V41S/H99V/C122S/R217V | 653 |
| 577 | F30Y/R35H/H37D/V38D/Y40H/V41R/D60aK/Y60bS/L97bA/H99Q/C122S/Y149R/M157K | 659 |
| 759 | V38D/L97bR/H99L/C122S/E175D/R217E/K224S | 661 |
| 769 | V38D/L97bK/H99L/C122S/R217E | 673 |
| 174 | F30H/V38D/V41R/L97bA/H99Q/C122S/Y151F/M157K | 688 |
| 867 | R35Q/V38D/Y40F/V41T/Y60bP/L97bG/H99Q/C122S | 698 |
| 462 | R36H/V38D/V41M/F59I/D97E/T97adel/A98G/L97bdel/H99L/C122S/R217D | 702 |
| 969 | F30Y/V38E/L97bR/C122S/Y151L/R217V | 702 |
| 914 | V38D/T39H/Y40F/V41K/L97bM/H99T/C122S/R217E | 717 |
| 386 | R37aS/V41R/L97bG/C122S/R217V | 726 |
| 379 | V38D/L97bR/H99Q/C122S/R217V | 731 |
| 885 | R37aS/V38D/V41R/L97bR/H99Q/C122S/Y151L/Q192T/R217V | 738 |
| 27 | R35Q/H37Y/R37aE/V38E/T39Y/D60aP/Y60bQ/T97aI/L97bA/H99Q/C122S/Y149R | 743 |
| 362 | R35V/R37aE/V38E/V41L/Y60bS/T97aE/L97bA/H99Q/C122S/Y149R | 765 |
| 241 | F30Y/V38D/Y40H/V41R/L97bA/H99Q/C122S/M157K/Q192H | 778 |
| 527 | F30Y/V38D/Y40H/V41R/L97bA/H99Q/C122S/M157K/K223N/P236S | 781 |
| 255 | F30Y/R35W/R36H/H37E/V38E/T39Q/Y40H/V41W/Y60bW/T97aI/L97bA/H99Q/C122S/Y149R/M157K/Q192F | 802 |
| 490 | F30Y/R37aH/V38D/Y40L/V41R/L97bA/H99Q/R110dH/C122S/M157K/V160I | 808 |
| 630 | F30Y/R35W/R36H/H37E/V38E/T39V/Y40H/V41W/Y60bS/T97aI/L97bA/H99Q/C122S/Y149R/M157K/Q192H | 819 |
| 771 | V38D/L97bV/H99L/C122S/K224A | 824 |
| 444 | R36H/V38D/Y40F/V41R/D97E/A98G/T97adel/H99L/L97bdel/C122S/Y151M/Q192D/R217D | 825 |
| 479 | F30Y/R36H/V38D/Y40F/V41R/L97bA/H99Q/C122S/Y151M/M157Y/Q192A | 830 |
| 812 | V38D/L97bT/H99L/C122S/E175D/R217K | 851 |
| 294 | V38E/T97aE/L97bA/H99Q/C122S | 862 |
| 580 | F30Y/R35Q/V38D/Y40H/V41R/D60aE/Y60bK/L97bA/H99Q/C122S/Y149R/M157K/R217I | 917 |
| 816 | V38D/L97bR/H99V/C122S/E175D/R217E/K224R | 930 |
| 853 | V38D/V41Q/Y60bP/T97aY/L97bR/H99L/C122S/Y151L/E175D/Q192K/R217E/K224R | 960 |
| 922 | R35Q/H37Y/R37aE/V38E/T39Y/V41R/L97bG/H99S/C122S | 989 |
| 852 | V38D/V41Q/D60aN/Y60bP/T97aN/L97bR/H99I/C122S/Y151L/E175D/Q192R/R217E/K224R | 993 |
| 635 | R35Q/H37D/V38D/T39H/V41R/Y60bP/L97bA/H99Q/C122S/Y149R/Q192T | 998 |
| 548 | F30H/V38D/L97bA/H99Q/C122S/Y151F/M157K | 1000 |
| 259 | F30Y/R35Y/R36H/H37E/V38E/T39R/Y40H/V41W/Y60bW/T97aI/L97bA/H99Q/C122S/Y149R/M157K/Q192F | 1030 |
| 847 | V38D/V41K/D60aE/Y60bP/T97aA/L97bR/H99L/C122S/Y151L/E175D/Q192R/R217E/K224R | 1040 |
| 851 | V38D/V41Q/D60aN/Y60bP/L97bR/H99L/C122S/Y151L/E175D/Q192R/R217E/K224R | 1040 |
| 336 | H37G/R37aD/G37bD/V38F/T39H/V41R/Y60bK/T97aS/L97bR/H99E/C122S/Y151L/E175D/Q192T/K224R | 1040 |
| 639 | R35Q/H37Y/V38D/T39F/V41R/Y60bP/L97bA/H99Q/C122S/Y149R/Q192G | 1130 |
| 215 | F30Y/R37aH/V38D/Y40Q/V41I/L97bA/H99Q/C122S/Y151L/M157W/Q192Y | 1140 |
| 631 | F30Y/R35Y/R36H/H37E/V38E/T39A/Y40H/V41W/Y60bV/T97aI/L97bA/H99Q/C122S/Y149R/M157K/Q192H | 1170 |
| 859 | R36H/V38D/T97aR/L97bG/H99Q/C122S/E175F | 1180 |
| 177 | F30H/V38D/V41R/L97bA/H99Q/C122S/Y149N/Y151F/M157K | 1190 |
| 305 | V38D/L97bG/H99Q/C122S | 1190 |
| 909 | R36S/V38D/T39K/Y40F/V41R/L97bN/H99E/C122S/R217S | 1230 |
| 251 | F30Y/V38D/Y40L/V41R/L97bA/H99Q/C122S/M157K/Q192H | 1240 |
| 423 | V38D/L97bA/H99Q/C122S | 1310 |
| 916 | V38D/T39L/Y40L/V41K/L97bH/H99L/C122S/R217A | 1320 |
| 642 | R35Q/H37G/V38D/T39W/V41R/Y60bP/L97bA/H99Q/C122S/Y149R/Q192G | 1340 |
| 929 | R37aS/V38D/T39V/V41E/L97bG/H99Q/C122S/R217T | 1390 |

TABLE 14-continued

| SEQ ID NO* | Mutation String | ED50 (nM) |
|---|---|---|
| 626 | F30Y/R35Y/R36H/H37E/V38E/T39L/Y40H/V41W/Y60bE/T97aI/L97bA/H99Q/C122S/Y149R/M157K/Q192F | 1450 |
| 863 | R37aS/V38D/V41R/D60aT/Y60bN/L97bG/H99Q/C122S | 1450 |
| 805 | V38E/T39W/V41T/D60aP/Y60bW/T97aI/L97bA/H99Q/C122S/Y149L/Y151G/Q192T | 1480 |
| 770 | V38D/L97bR/H99L/C122S/E175D/R217T/K224S | 1570 |
| 808 | V38D/L97bR/H99M/C122S/E175D/R217E | 1570 |
| 424 | R36S/V38D/L97bR/H99E/C122S/R217D/K224R | 1580 |
| 432 | R36H/V38D/V41R/A96D/D97G/T97adel/A98G/L97bdel/H99L/C122S/Y151F/Q192D/R217D | 1600 |
| 809 | V38D/L97bR/H99M/C122S/E175D/R217E/K224R | 1660 |
| 634 | F30Y/R35W/R36H/H37E/V38E/T39V/Y40H/V41W/Y60bA/T97aI/L97bA/H99Q/C122S/Y149R/M157K/Q192A | 1760 |
| 197 | I17L/F30Y/V38D/Y40H/V41R/L97bA/H99Q/C122S/M157K | 1790 |
| 632 | F30Y/R35Y/R36H/H37P/V38E/T39R/Y40H/V41W/Y60bE/T97aI/L97bA/H99Q/C122S/M157K/Q192F | 1900 |
| 810 | V38D/L97bR/C122S/E175D/R217E/K224R | 1990 |
| 761 | V38D/L97bR/H99E/C122S/E175D/R217S/K224S | 2040 |
| 532 | F30H/V38D/Y40H/V41Q/L97bA/H99Q/C122S/Q192H | 2110 |
| 482 | F30Y/V38D/Y40H/V41K/L97bA/H99Q/C122S/Y151R/M157R | 2190 |
| 491 | F30Y/A32E/Y34N/V38D/Y40H/V41R/L97bA/H99Q/C122S/M157K | 2210 |
| 422 | A32S/V38D/H99E/C122S/K224A | 2230 |
| 493 | F30Y/V38D/V41R/L97bA/H99Q/C122S/M157K | 2240 |
| 762 | V38D/L97bR/H99V/C122S/E175D/R217E/K224N | 2240 |
| 533 | F30Q/V38D/Y40L/V41R/L97bA/H99Q/C122S/Y151H/M157R/Q192Y | 2300 |
| 179 | F30H/V38D/V41R/L97bV/H99Q/C122S/Y151F/M157K | 2390 |
| 772 | V38D/L97bR/H99V/C122S/E175D/R217E/K224S | 2490 |
| 756 | V38D/L97bR/H99E/C122S/Y172F/E175D/R217E | 2720 |
| 154 | V38D/T97adel/L97bdel/C122S | 2950 |
| 180 | F30H/V38D/V41R/L97bV/H99Q/C122S/Y149N/Y151F/M157K | 3230 |
| 765 | V38D/L97bG/H99Q/C122S/E175D/R217K/K224A | 3310 |
| 5 | C122S | 3380 |
| 192 | F30Y/R35Q/V38D/Y40H/V41R/L97bA/H99Q/C122S/Y149L/M157K/R217G | 3860 |
| 461 | R36H/V38D/V41K/D97E/A98G/T97adel/H99L/L97bdel/C122S/V213A/R217D | 4030 |
| 182 | F30Y/V38D/Y40H/V41R/L97bA/H99Q/C122S/M157K/R217G | 4210 |
| 489 | F30Y/A32E/V38D/Y40H/V41R/L97bA/H99Q/C122S/M157K | 4280 |
| 172 | F30Y/V38D/V41R/L97bV/H99Q/C122S/Y151F/M157K | 5890 |
| 178 | F30Y/V38D/V41R/L97bV/H99Q/C122S/M157K | 6030 |
| 181 | F30Y/V38D/V41R/L97bV/H99Q/C122S/Y149N/Y151F/M157K | 7110 |
| 530 | F30H/V38D/L97bA/H99Q/C122S/Y151L/M157S/Q192L | 7340 |
| 194 | F30Y/H37D/V38D/Y40H/V41R/L97bA/H99Q/C122S/Y149L/M157K/R217G | 7760 |
| 755 | V38D/L97bR/H99E/C122S/E175D/R217A/K224S | 7770 |
| 758 | V38D/L97bR/H99E/C122S/E175D/R217A/K224Q | 7770 |
| 775 | F30Y/V38D/Y40H/V41K/L97bA/H99Q/C122S/Y151K/M157R/Q192E | 7770 |
| 776 | F30Y/V38D/Y40H/V41K/L97bA/H99Q/C122S/Y151K/M157S/Q192E | 7770 |
| 777 | F30Y/V38D/Y40H/V41K/L97bA/H99Q/C122S/Y151K/Q192E | 7770 |
| 778 | F30M/V38D/Y40F/V41R/L97bA/H99Q/C122S/Y151G/Q192T | 7770 |
| 779 | F30H/V38D/V41R/L97bA/H99Q/C122S/Y151M/M157R/Q192T | 7770 |
| 780 | F30H/V38D/Y40P/V41K/L97bA/H99Q/C122S/Y151H/M157E/Q192A | 7770 |
| 296 | V38D/L97bR/H99E/C122S/E175D | 7770 |
| 804 | V38E/T39W/V41T/D60aP/Y60bQ/T97aE/L97bA/H99Q/C122S/Y149V/Y151G/Q192T | 7770 |
| 303 | V38D/H99Q/C122S/R217Q | 7770 |
| 304 | V38D/L97bG/C122S/R217Q | 7770 |
| 856 | V38D/V41R/L97bT/C122S/Y151F/R217E | 7770 |
| 858 | V38D/V41R/L97bN/H99E/C122S/E175D/Q192M/R217E | 7770 |
| 911 | R36H/V38D/T39R/Y40F/V41R/H99S/C122S/R217T | 7770 |
| 918 | R36S/V38D/T39A/V41R/L97bV/H99S/C122S/R217T | 7770 |
| 905 | R36L/V38D/T39R/Y40L/V41T/L97bD/H99P/C122S/R217S | 7770 |
| 913 | R36S/V38D/T39K/Y40M/V41K/L97bI/C122S/R217E | 7770 |
| 919 | R37aH/V38D/T39R/Y40F/L97bT/C122S/R217E | 7770 |
| 910 | V38D/T39K/Y40F/V41Q/L97bI/H99S/C122S/R217T | 7770 |
| 917 | V38D/T39F/Y40L/V41K/L97bT/H99S/C122S/R217T | 7770 |
| 480 | F30Y/V38D/Y40L/V41R/L97bA/H99Q/C122S/Y151L/M157T/Q192L | 9990 |
| 474 | F30H/V38D/Y40F/V41R/L97bA/H99Q/C122S/Y151R/M157K | 9990 |
| 472 | F30H/V38D/V41R/L97bA/H99Q/C122S/Y151F/M157K/Q192W | 9990 |
| 185 | F30Y/V38D/Y40H/V41R/L97bA/H99Q/C122S/Y149L/M157K/R217G | 9990 |
| 188 | F30Y/V38D/Y40H/V41R/L97bA/H99Q/C122S/Y149F/M157K/R217G | 9990 |
| 266 | F30Y/R35W/R36H/H37E/V38E/T39W/Y40H/V41R/Y60bQ/T97aE/L97bA/H99Q/C122S/Y149K/M157K/Q192P | 9990 |
| 781 | R37aH/V38E/T39S/D60aR/Y60bG/T97aE/L97bA/H99Q/C122S/Y149T/Y151S | 9990 |
| 782 | R37aH/V38E/T39A/V41R/D60aG/Y60bG/T97aI/L97bA/H99Q/C122S/Y149V/Y151F/Q192R | 9990 |
| 783 | R37aH/V38E/T39H/V41R/D60aT/Y60bT/T97aI/L97bA/H99Q/C122S/Y149M/Y151N/Q192T | 9990 |
| 784 | R37aH/V38E/T39G/V41A/D60aG/Y60bE/T97aE/L97bA/H99Q/C122S/Y149R/Y151K/Q192T | 9990 |
| 785 | V38E/T39D/V41A/D60aA/Y60bR/T97aE/L97bA/H99Q/C122S/Y149W/Y151K/Q192T | 9990 |
| 786 | V38E/T39A/V41R/D60aH/Y60bH/T97aI/L97bA/H99Q/C122S/Y149M/Y151N/Q192T | 9990 |

TABLE 14-continued

| SEQ ID NO* | Mutation String | ED50 (nM) |
|---|---|---|
| 787 | V38E/T39F/V41R/Y60bN/T97aE/L97bA/H99Q/C122S/Y149A/Y151G/Q192T | 9990 |
| 789 | R37aH/V38E/V41A/Y60bS/T97aE/L97bA/H99Q/C122S/Y149A/Y151M/Q192T | 9990 |
| 790 | R37aH/V38E/T39S/V41A/D60aG/Y60bE/T97aE/L97bA/H99Q/C122S/Y149S/Y151H | 9990 |
| 791 | R37aP/V38E/T39G/V41R/Y60bR/T97aE/L97bA/H99Q/C122S/Y149T/Y151P/Q192T | 9990 |
| 788 | V38E/T39D/V41A/D60aS/Y60bR/T97aE/L97bA/H99Q/C122S/Y149W/Y151K/Q192T | 9990 |
| 298 | V38D/L97bR/H99E/C122S/E175D/K224R | 9990 |
| 806 | V38E/T39W/V41Q/Y60bE/T97aE/L97bA/H99Q/C122S/Y149I/Y151G/Q192T | 9990 |
| 803 | V38E/T39W/V41T/Y60bK/T97aE/L97bA/H99Q/C122S/Y149I/Y151G/Q192T | 9990 |
| 857 | V38D/V41K/L97bA/H99L/C122S/Y151R/R217E | 9990 |
| 915 | R36S/V38D/T39K/Y40M/V41K/L97bH/H99T/C122S/R217S | 9990 |
| 641 | R35D/H37R/V38D/T39V/V41T/Y60bT/L97bA/H99Q/C122S/Q192A | 16600 |
| 5 | C122S | NA |
| 154 | V38D/T97a_L97bdel/C122S | NA |
| 155 | L73R/L97bG/H99Q/C122S | NA |
| 409 | V38D/V41T/A96E/D97E/T97aG/A98_H99del/C122S/E175K/R217H | NA |
| 407 | V38D/V41S/A96E/D97E/T97aG/A98_H99del/C122S/E175K | NA |
| NA | V38D/V41S/D97E/A96_-nulldelinsVG/A98_H99del/C122S/E175K/R217H | NA |
| 408 | V38D/V41A/A96_T97adelinsERG/A98_H99del/C122S/E175N | NA |
| NA | V38D/V41L/A96_A98del/-null_H100insRGL/C122S/Y172E/E175P | NA |
| 406 | V38D/V41S/A96D/D97E/T97aG/A98_H99del/C122S/E175S | NA |
| NA | V38D/V41A/A96del/-nulldelinsRG/A98_H99del/C122S/E175N/R217delinsF | NA |
| 405 | V38D/V41S/A96_T97adelinsERG/A98_H99del/C122S/E175A | NA |
| 156 | V38D/L73R/L97bG/H99Q/C122S | NA |
| NA | V38D/A96_-nulldelinsVG/D97E/A98_H99del/C122S | NA |
| NA | V38D/V41Q/A96_-nulldelinsAG/D97E/A98_H99del/C122S/R217K/K224R | NA |
| NA | R35S/V38_Y40delinsDRF/D60adelinsY/A96del/-nulldelinsLK/A98_H99del/C122S/Y151L | NA |
| NA | R35T/V38_V41delinsDRF/V41M/D60aP/A96del/-nulldelinsLK/A98_H99del/C122S/Y151L | NA |
| NA | R35K/V38_-nulldelinsDQHR/A96del/-nulldelinsLK/A98_H99del/C122S/Y151W | NA |
| 410 | R35K/V38D/T39S/Y40F/V41M/D60aN/A96D/D97L/A98K/T97adel/H99L/L97bdel/C122S/Y151L | NA |
| NA | R35K/V38D/T39S/Y40F/V41M/D60aN/A96del/-nulldelinsLK/A98_H99del/C122S/Y151L | NA |
| NA | R35S/V38E/T39S/Y40H/V41R/A96del/-nulldelinsLK/A98_H99del/C122S/Y151W | NA |
| NA | R35K/V38D/T39K/Y40F/A96del/-nulldelinsLK/A98_H99del/C122S/Y151delinsG | NA |
| 411 | V38D/V41R/A96E/D97G/T97adelinsSG/A98_H99del/C122S | NA |
| 412 | V38D/L97bG/H99P/C122S/R217V/K224Q | NA |
| 412 | V38D/L97bG/H99P/C122S/R217V/K224Q | NA |
| 413 | V38D/A96G/D97R/A98G/T97adel/H99I/L97bdel/C122S | NA |
| NA | V38D/A96_-nulldelinsRGI/A98G/C122S | NA |
| 414 | V38D/A96E/D97E/T97aG/A98_H99del/L97bM/C122S | NA |
| NA | V38D/V41R/A96del/-null_T97ainsG/-null_L97binsG/A98_H99del/C122S/R217A | NA |
| 415 | V38D/V41R/A96D/D97G/T97aN/A98G/L97bdel/H99L/C122S/R217F | NA |
| NA | V38D/V41R/-nulldelinsDG/D97N/T97aG/A98_H99del/C122S/R217delinsF | NA |
| NA | V38D/V41R/A96E/-null_L97binsG/D97E/A98_H99del/C122S/E175K/R217E/K224S | NA |
| 416 | V38D/V41Q/A96E/D97E/A98G/T97adel/H99L/L97bdel/C122S/R217H | NA |
| 416 | V38D/V41Q/A96E/D97E/T97aG/A98_H99del/C122S/R217H | NA |
| NA | V38D/V41S/A96del/-nulldelinsRG/A98_H99del/C122S/R217delinsY | NA |
| NA | V38D/V41R/A96del/-nulldelinsGG/A98_H99del/C122S/R217D | NA |
| 418 | V38D/V41K/A96D/D97E/T97aG/A98_H99del/C122S/R217K/K224N | NA |
| 419 | R36H/V38D/V41M/D97E/T97aG/A98_H99del/C122S/R217D | NA |
| 419 | R36H/V38D/V41M/D97E/A98G/T97adel/H99L/L97bdel/C122S/R217D | NA |
| 420 | V38D/V41H/A96D/D97E/T97aG/A98_H99del/C122S/R217delinsF | NA |
| 421 | V38D/D97E/T97aG/A98_H99del/C122S/E175G/R217H | NA |
| NA | V38D/A96P/D97_-nulldelinsVG/A98_H99del/C122S | NA |
| 157 | L97bP/H99L/C122S | NA |
| NA | -null_H99delinsRVG/L97bM/C122S | NA |
| NA | V41R/A96del/-null_T97ainsG/-null_L97binsG/A98_H99del/C122S | NA |
| NA | -null_H99delinsRG/D97G/L97bM/C122S/R217E/K224R | NA |
| 423 | V38D/L97bA/H99Q/C122S | NA |
| 425 | V38D/V41Q/A96N/D97G/T97aI/A98G/L97bdel/H99L/C122S | NA |
| 427 | V38D/V41K/A96K/D97E/A98G/T97adel/H99L/L97bdel/C122S | NA |
| 426 | R35S/V38D/V41T/A96D/D97G/A98G/T97adel/H99L/L97bdel/C122S | NA |
| 428 | R36H/V38D/V41S/A96E/D97R/A98G/T97adel/H99L/L97bdel/C122S/K224R | NA |
| 158 | R37aP/V38D/V41R/A96D/D97G/T97aN/A98G/L97bdel/H99L/C122S/M157K/R217F | NA |
| 159 | R37aS/G37bD/V38D/V41R/A96D/D97G/T97aN/A98G/L97bdel/H99L/C122S/R217F | NA |
| 160 | R36H/V38D/V41R/A96D/D97G/A98R/T97adel/H99L/L97bdel/C122S/M157K/R217D | NA |
| 161 | R37aH/V38D/V41R/A96D/D97G/A98G/T97adel/H99L/L97bdel/C122S/S174P/R217D | NA |
| 162 | R37aH/V38D/V41G/A96G/D97E/T97aA/A98G/L97bdel/H99M/C122S/Y151N | NA |
| 163 | R36S/V38D/Y40L/V41R/A96P/D97V/T97aR/A98G/L97bdel/H99L/C122S | NA |
| 165 | V38D/V41R/A96D/D97G/A98G/T97adel/H99L/L97bdel/C122S/Q192E/R217D | NA |
| 166 | F30Y/V38D/V41R/A96D/D97G/A98G/T97adel/H99L/L97bdel/C122S/M157K/R217D | NA |
| 431 | V38D/V41R/A96D/D97G/A98G/T97adel/H99L/L97bdel/C122S/Y151K/Q192E/R217D | NA |
| 433 | V38D/V41R/A96D/D97G/A98G/T97adel/H99L/L97bdel/C122S/Y151W/Q192M/R217D | NA |
| 437 | V38D/V41R/A96D/D97G/A98G/T97adel/H99L/L97bdel/C122S/Y151N/Q192M/R217D | NA |

TABLE 14-continued

| SEQ ID NO* | Mutation String | ED50 (nM) |
|---|---|---|
| 439 | R36H/V38D/Y40H/V41K/D97E/A98G/T97adel/H99L/L97bdel/C122S/Y151K/Q192V/R217D | NA |
| 440 | R36H/V38D/Y40L/V41K/D97E/A98G/T97adel/H99L/L97bdel/C122S/Y151R/Q192L/R217D | NA |
| 441 | R36H/V38D/Y40V/V41K/D97E/A98G/T97adel/H99L/L97bdel/C122S/Y151F/Q192F/R217D | NA |
| 442 | R36H/V38D/D97E/A98G/T97adel/H99L/L97bdel/C122S/Y151K/Q192E/R217D | NA |
| 443 | R36H/V38D/Y40L/V41K/D97E/A98G/T97adel/H99L/L97bdel/C122S/Y151K/Q192E/R217D | NA |
| 449 | R36H/V38D/V41K/D97E/A98G/T97adel/H99L/L97bdel/C122S/Y151K/Q192E/R217D | NA |
| 453 | R36H/V38D/Y40F/V41K/D97E/A98G/T97adel/H99L/L97bdel/C122S/Y151R/Q192E/R217D | NA |
| 454 | R36H/V38D/Y40L/V41R/D97E/A98G/T97adel/H99L/L97bdel/C122S/Y151N/Q192V/R217D | NA |
| 455 | R36H/V38D/Y40L/V41R/D97E/A98G/T97adel/H99L/L97bdel/C122S/Y151N/Q192D/R217D | NA |
| 456 | R36H/V38D/V41R/D97E/A98G/T97adel/H99L/L97bdel/C122S/Y151K/Q192E/R217D | NA |
| 457 | R36H/V38D/Y40F/V41R/D97E/A98G/T97adel/H99L/L97bdel/C122S/Y151K/Q192E/R217D | NA |
| 458 | R36H/V38D/Y40I/V41A/D97E/A98G/T97adel/H99L/L97bdel/C122S/Y151M/Q192L/R217D | NA |
| 459 | R36H/V38D/Y40H/V41M/D97E/A98G/T97adel/H99L/L97bdel/C122S/R217D | NA |
| 464 | R36H/V38D/V41R/A96D/D97G/T97aN/A98G/L97bdel/H99L/C122S/G193R/R217F | NA |
| 467 | V38D/V41R/A96D/D97G/A98G/T97adel/H99L/L97bdel/C122S/Q192R/R217D | NA |
| 468 | F21S/R36H/V38D/V41R/A96D/D97G/A98G/T97adel/H99L/L97bdel/C122S/E175D/R217D | NA |
| 470 | R36H/V38D/V41R/A96D/D97E/A98G/T97adel/H99L/L97bdel/C122S/G193R/R217D | NA |
| 168 | V38D/Y40P/V41K/L97bA/H99Q/C122S/M157K | NA |
| 430 | V38D/V41R/A96D/D97G/A98G/T97adel/H99L/L97bdel/C122S/Y151M/Q192E/R217D | NA |
| 512 | F30H/R35T/H37M/V38D/V41R/D60aS/Y60bT/L97bA/H99Q/A112V/C122S/Y151L/M157K/R217T | NA |
| 220 | V38D/V41R/L97bA/H99Q/C122S | NA |
| 531 | F30N/V38D/Y40F/V41R/L97bA/H99Q/C122S/Y151L/M157S/Q192H | NA |
| 257 | F30Y/R35Y/R36H/H37E/V38E/T39S/Y40H/V41W/Y60bW/T97aI/L97bA/H99Q/C122S/Y149R/M157K/Q192F | NA |
| 306 | V38D/L97bG/H99Q/C122S/S195A/R217Q | NA |
| 342 | V38D/C122S/S190H/G216A | NA |

*SEQ ID the of an exemplary protease domain containing the replacements

Example 3

Anti-C3 Activity of u-PA Variants in Cynomolgus Monkey Plasma

The ex vivo anti-C3 activity of some modified u-PA polypeptides was measured in purchased cynomolgus monkey plasma (BioChemed). The median effective dose (ED$_{50}$) of modified u-PA polypeptides for cleaving C3 was calculated using ELISA. Briefly, exemplary modified u-PA polypeptides were serially diluted 1:1.5 fold from 1000 nM to 39.0 nM (9 point dilution). The hC3 standard was serially diluted 1:1.5 fold from 450 to 39 (7 point dilution) in 1% BSA in 1×PBST (Phosphate Buffered Saline Tween-20) A recipe for 1×PBST includes:

1. Dissolve the following in 800 ml of distilled $H_2O$
   8 g of NaCl
   0.2 g of KCl
   1.44 g of $Na_2HPO_4$
   0.24 g of $KH_2PO_4$
   2 ml of tween-20
2. Adjust pH to 7.2
3. Adjust volume to 1 L with additional distilled $H_2O$
4. Sterilize by autoclaving.

80% Cynomolgus vitreous plasma (obtained from BioChemed) in buffer containing 50 mM Tris, pH 8.0, 50 mM NaCl, and 0.01% Tween-20, and dilutions of C3, was incubated with modified u-PA polypeptides at a final concentration of 0.1 μM at 37° C. for 10 minutes. The 80% plasma digests were diluted 1:15,625 in 1% BSA in 1×PBST using the Biomek liquid handling system (Beckman Coulter). Flat bottom EIA plates (Bio-Rad) coated with purified A213 antibody (anti-C4; Quidel specialty products) at 2.0 μg/mL, were incubated with 50 μL/well of sample or standard and detected with Anti-hC3a antibody (ab11872; Abcam) in 1% BSA in 1×PBST. The wells were further coated with HRP conjugate Goat anti Mouse-HRP antibody (Jackson ImmunoResearch; catalog number: 115-035-003) at a 1:30,000 dilution in 10 BSA in 1×PBST and developed with WesternBright ECL (chemiluminescent) HIRP substrate for detection.

The $ED_{50}$ is defined as the concentration of protease that produces a 50% loss of C3. The results show an increased loss (i.e., cleavage) of C3 in the presence of the modified u-PA polypeptides with the sequence set forth in SEQ ID NOs: 8-14 and 16-20. The u-PA polypeptide protease domain with the sequence set forth in SEQ TD NO: 8, cleaved with an $ED_{50}$ that was several fold higher than the others. The results are set forth in Table 15 below.

TABLE 15 anti-C3 Activity in cynomolgus monkey plasma

| Chymotrypsin numbering | SEQ ID NO* | $ED_{50}$ 80% cynomolgus plasma (10 min, nM) |
|---|---|---|
| F30Y/V38D/Y40H/V41R/L97bA/H99Q/C122S/M157K | 8 | 1700 |

TABLE 15-continued anti-C3 Activity in cynomolgus monkey plasma

| Chymotrypsin numbering | SEQ ID NO* | ED$_{50}$ 80% cynomolgus plasma (10 min, nM) |
|---|---|---|
| F30Y/R35W/R36H/H37E/V38E/T39W/Y40H/V41R/Y60bQ/T97aE/L97bA/H99Q/C122S/Y149K/M157K | 9 | 176 |
| F30Y/R35W/R36H/H37D/V38E/T39Y/Y40F/V41R/T97aI/L97bA/H99Q/C122S/Y149R/M157K | 10 | 114 |
| R35W/R36H/H37N/V38E/T39F/Y40F/V41R/T97aI/L97bA/H99Q/C122S/Y149R/M157K/Q192H | 11 | 309 |
| F30Y/R35Y/R36H/H37K/V38E/T39F/Y40F/V41R/T97aI/L97bA/H99Q/C122S/Y149R/M157K | 12 | 286 |
| F30Y/R35W/R36H/H37N/V38E/T39Y/Y40F/V41R/Y60bS/T97aE/L97bA/H99Q/C122S/Y149K/M157K | 13 | 222 |
| F30Y/R35W/R36H/H37P/V38E/T39Y/Y40F/V41R/Y60bS/T97aE/L97bA/H99Q/C122S/Y149K/M157K | 14 | 145 |
| F30Y/R35Q/R36H/H37G/R37aE/V38E/T39F/Y40F/V41R/D60aP/Y60bS/T97aI/L97bA/H99Q/C122S/Y149R/M157K | 16 | 481 |
| F30Y/R35Y/R36H/H37P/R37aQ/V38E/T39Y/Y40F/V41R/Y60bH/T97aI/L97bA/H99Q/C122S/Y149R/M157K | 17 | 215 |
| R35Q/H37Y/R37aE/V38E/T39Y/V41R/D60aT/Y60bT/T97aI/L97bA/H99Q/C122S/Y149R | 18 | 244 |
| R35W/H37P/R37aN/V38E/T39Y/V41R/D60aP/Y60bL/T97aI/L97bA/H99Q/C122S/Y149R | 19 | 214 |
| R35W/H37D/R37aP/V38E/T39W/V41R/Y60bA/T97aI/L97bA/H99Q/C122S/Y149R | 20 | 175 |

*SEQ ID the of exemplary protease domain containing the replacements

Example 4

Anti-C3 Activity of Modified u-PA Polypeptides in Cynomolgus Monkey Vitreous Humor The activity of modified u-PA polypeptides was assessed by cleavage of the substrate complement protein human C3. 2 µM purified human C3 (Complement Technologies; Tyler, Tex.) was incubated with the modified u-PA polypeptides (0-250 nM) for 1 hour at 37° C. in purchased monkey vitreous humor (BioChemed). The activity of the modified u-PA polypeptides was then quenched by the addition of the urokinase inhibitor Glu-Gly-Arg Chloromethyl Ketone (EGR-CMK; Haematologic Technologies, EGRCK-01) to a final concentration of 10 µM and the hC3/modified u-PA polypeptide mixture was allowed to stand for 30 minutes at ambient temperature.

Residual levels of undigested human C3 were quantified using an ELISA. All modified u-PA polypeptides, including those that contain the replacements R35Q/H37Y/R37aE/V38E/T39Y/V41R/D60aP/Y60bQ/T97aI/L97bA/H99Q/C122S/Y149R, Y40Q/V41L/L97bA/C122S, and Y40Q/V41R/L97bA/C122S, cleaved complement protein C3 with a higher turnover number (per hour) than the reference u-PA polypeptide containing the C122S replacement set forth in SEQ ID NO: 5. The results are set forth in Table 16 below.

TABLE 16

C3 cleavage in vitreous humor

| Chymotrypsin numbering | SEQ ID NO* | C3 Turnover Number (hr$^{-1}$) |
|---|---|---|
| u-P wild type u-PA with C122S | 5 | 0.3 |
| V38E/Y40Q/V41L/Y60bL/L97bA/H99Q/C122S | 15 | 29 |
| R35Q/H37Y/R37aE/V38E/T39Y/V41R/D60aP/Y60bQ/T97aI/L97bA/H99Q/C122S/Y149R | 21 | 48 |
| Y40Q/V41L/L97bA/C122S | 40 | 8 |
| Y40Q/V41L/Y60bL/L97bA/H99Q/C122S | 34 | 42 |
| V38E/Y40Q/Y60bL/L97bA/H99Q/C122S | 35 | 17 |
| V38E/Y40Q/V41L/L97bA/H99Q/C122S | 36 | 56 |
| V38E/Y40Q/V41L/Y60bL/H99Q/C122S | 37 | 18 |
| V38E/Y40Q/V41L/Y60bL/L97bA/C122S | 38 | 12 |
| R37aS/V41R/L97bG/H99Q/C122S | 41 | 5 |
| T39Y/V41R/L97bA/H99Q/C122S | 42 | 17 |
| T39Y/V41R/Y60bQ/L97bA/H99Q/C122S | 43 | 26 |
| T39Y/V41R/D60aP/L97bA/H99Q/C122S | 44 | 17 |

*SEQ ID the of protease domain containing the replacements

Example 5

Ex Vivo Stability of Modified u-PA Polypeptides in Cynomolgus Monkey Vitreous Humor The ex vivo stability of modified u-PA polypeptides was assessed in purchased cynomolgus monkey vitreous humor or Phosphate Buffered Saline (PBS) control. Modified u-PA polypeptides that exhibit stability in vitreous humor can be used for treatment of AMD.

80% Cynomolgus vitreous humor (obtained from BioChemed; Catalog Nos. BC7615-V1, BC60815-V1, BC33115-V6) in buffer containing 50 mM Tris, pH 8.0, 50 mM NaCl, and 0.01% Tween-20 or PBS control was incubated with modified u-PA polypeptides at a final concentration of 0.1 µM. These mixtures were incubated at 37° C. for 7 days, and the residual protease activity was assayed with 100 M fluorogenic substrate AGR-ACC (7-amino-4-carbamoylmethyl-coumarin) in 50 mM Tris, pH 8.0, 50 mM NaCl, 0.01% Tween-20 (assay results were assessed at excitation wavelength=380 nm and emission wavelength=460 nm). The results show that the modified u-PA polypeptides with the sequence set forth in SEQ ID NOs: 21-33 exhibit comparable activity in cynomolgus plasma and PBS. The results are set forth in Table 17 below.

TABLE 17

Stability of Modified u-PA polypeptides in vitreous humor

| Chymotrypsin numbering | SEQ ID NO* | Activity (%) on Day 7 vitreous | PBS |
|---|---|---|---|
| wild type u-PA protease domain with C122S | 5 | 102 | 111 |
| R35Q/H37Y/R37aE/V38E/T39Y/V41R/D60aP/Y60bQ/T97aI/L97bA/H99Q/C122S/Y149R | 21 | 83 | 94 |
| H37Y/R37aE/V38E/T39Y/V41R/D60aP/Y60bQ/T97aI/L97bA/H99Q/C122S/Y149R | 22 | 73 | 79 |
| R35Q/R37aE/V38E/T39Y/V41R/D60aP/Y60bQ/T97aI/L97bA/H99Q/C122S/Y149R | 23 | 88 | 92 |
| R35Q/H37Y/V38E/T39Y/V41R/D60aP/Y60bQ/T97aI/L97bA/H99Q/C122S/Y149R | 24 | 87 | 99 |
| R35Q/H37Y/R37aE/T39Y/V41R/D60aP/Y60bQ/T97aI/L97bA/H99Q/C122S/Y149R | 25 | 105 | 103 |

TABLE 17-continued

Stability of Modified u-PA polypeptides in vitreous humor

| Chymotrypsin numbering | SEQ ID NO* | Activity (%) on Day 7 vitreous | PBS |
|---|---|---|---|
| R35Q/H37Y/R37aE/V38E/V41R/D60aP/Y60bQ/T97aI/L97bA/H99Q/C122S/Y149R | 26 | 93 | 108 |
| R35Q/H37Y/R37aE/V38E/T39Y/D60aP/Y60bQ/T97aI/L97bA/H99Q/C122S/Y149R | 27 | 88 | 100 |
| R35Q/H37Y/R37aE/V38E/T39Y/V41R/Y60bQ/T97aI/L97bA/H99Q/C122S/Y149R | 28 | 93 | 97 |
| R35Q/H37Y/R37aE/V38E/T39Y/V41R/D60aP/T97aI/L97bA/H99Q/C122S/Y149R | 29 | 58 | 61 |
| R35Q/H37Y/R37aE/V38E/T39Y/V41R/D60aP/Y60bQ/L97bA/H99Q/C122S/Y149R | 30 | 86 | 92 |
| R35Q/H37Y/R37aE/V38E/T39Y/V41R/D60aP/Y60bQ/T97aI/H99Q/C122S/Y149R | 31 | 90 | 111 |
| R35Q/H37Y/R37aE/V38E/T39Y/V41R/D60aP/Y60bQ/T97aI/L97bA/C122S/Y149R | 32 | 89 | 108 |
| R35Q/H37Y/R37aE/V38E/T39Y/V41R/D60aP/Y60bQ/T97aI/L97bA/H99Q/C122S | 33 | 74 | 99 |

*SEQ ID the of exemplary protease domain containing the replacements

The ex vivo stability of the anti-C3 u-PA variants in Table 18 below was assessed after incubation in purchased cynomolgus monkey vitreous humor for both 7 and 28 days. The results show that several of the variants maintain significant activity even after the 28 day incubation. The results are set forth in Table 18 below.

TABLE 18

Stability of Modified u-PA polypeptides in vitreous humor

| Chymotrypsin numbering | SEQ ID NO* | Activity (%) Day 7 | Day 28 |
|---|---|---|---|
| wild type u-PA with C122S | 5 | 106 | 90 |
| V38E/Y40Q/V41L/Y60bL/L97bA/H99Q/C122S | 15 | 43 | n/d |
| R35Q/H37Y/R37aE/V38E/T39Y/V41R/D60aP/Y60bQ/T97aI/L97bA/H99Q/C122S/Y149R | 21 | 83 | 34 |
| Y40Q/V41L/Y60bL/L97bA/H99Q/C122S | 34 | 42 | n/d |
| V38E/Y40Q/Y60bL/L97bA/H99Q/C122S | 35 | 28 | n/d |
| V38E/Y40Q/V41L/L97bA/H99Q/C122S | 36 | 17 | n/d |
| V38E/Y40Q/V41L/Y60bL/H99Q/C122S | 37 | 73 | n/d |
| V38E/Y40Q/V41L/Y60bL/L97bA/C122S | 38 | 71 | n/d |
| Y40Q/V41L/L97bA/C122S | 40 | 56 | 28 |
| R37aS/V41R/L97bG/H99Q/C122S | 41 | 100 | 74 |
| T39Y/V41R/L97bA/H99Q/C122S | 42 | 92 | 61 |
| T39Y/V41R/Y60bQ/L97bA/H99Q/C122S | 43 | 98 | 58 |
| T39Y/V41R/D60aP/L97bA/H99Q/C122S | 44 | 86 | 42 |

*SEQ ID the of protease domain containing the replacements

Example 6

Ex Vivo Pharmacodynamic Assay in Human Plasma

Modified u-PA polypeptides (protease domains) were incubated with 80% human plasma prior to addition of erythrocytes to assess cleavage of complement protein C3 in a hemolytic assay of complement activity. Performing functional assays in the presence of human plasma tests the activity of the anti-C3 proteases in a pharmaceutically relevant environment and, for example, examines whether they are sensitive to inactivation by serpins or other protease inhibitors present in human blood. The modified u-PA polypeptides provided herein were not inhibited, in general, in the presence of human plasma. This is of significance for treatment of diseases and disorders and conditions, such as DGF, in which the administered modified u-PA polypeptides are exposed to human plasma, such as when administered intravenously. It is of lesser or no importance for applications, such as treatment of AMD by intravitreal or intraretinal or subretinal injection, where the modified u-PA polypeptides are not exposed to plasma.

An $ED_{50}$ value, which is the concentration of protease at which 50% inhibition of complement activity is achieved, was measured. The wild-type u-PA protease domain (SEQ ID NO:5, with C122S), and various exemplary modified u-PA protease domains were serially diluted from 3 µM to 0.11 µM (9 point serial dilution 1:2) to measure the $ED_{50}$. The wild-type u-PA (SEQ ID NO:5) protease domain and modified u-PA protease domains were preincubated with a final concentration of 80% plasma in an 0.2 mL tube by combining 4 µL of the diluted protease solution and 16 µL of human plasma (with sodium citrate as an anticoagulant; Innovative Research, Inc.). This resulted in a further dilution of the protease to give a final concentration of 0.6 µM to 0.0022 µM protease for the $EC_{50}$ protocol. A no-protease control (18 µL plasma and 2 µL PBST) and a background control (20 µL PBST only) also were included in the assays. The reaction was incubated at 37° C. for 1 hour. The reaction mixtures were further diluted to 20% plasma with the addition of 70 µL PBST.

Sensitized sheep erythrocytes (Diamdex, Miami, Fla.) were concentrated to 10× by pelleting a 3.0 ml aliquot, removing 2.7 mL of buffer and resuspending the cell pellet in the remaining 0.3 ml buffer. The concentrated sensitized erythrocytes were added to polypropylene 96-well plates at a volume of 12 µL per well. Preincubated protease/plasma mixtures at 6 µL or 60 µL were added to the erythrocytes to give a final concentration of 1% plasma or 10% plasma, respectively, in a final volume of 120 µL (PBST added to final volume). The solution was incubated with shaking at room temperature for 45 minutes. The cells were spun down at 2000 rpm for 5 minutes to pellet the unbroken cells, and 100 µL of the supernatant was removed and placed in a clear 96-well microtiter plate.

Release of hemoglobin from the lysed red blood cells was monitored by reading the optical density (OD) at 415 nm. The fraction hemolysis was calculated by subtracting the background control from all of the wells, then dividing the experimental samples by the no-protease control (positive control), where the fraction of hemolysis of the positive control was set at 1.00. The $ED_{50}$ (nM) of hemolysis by the proteases were measured by plotting the fraction hemolysis vs. protease concentration on a 4 parameter logistic curve fit (SoftMax Pro software, Molecular Devices, CA).

The results are shown in Table 19 below, which sets forth the $ED_{50}$ (nM) for hemolysis in 80% human plasma by wild type u-PA with the C122S mutation set forth in SEQ ID NO: 5 and the modified u-PA polypeptides. As shown in Table 19, the $ED_{50}$ for wild type u-PA in 80% human plasma is greater than 6 µM; whereas exemplary modified u-PA protease domain polypeptides have significantly increased ability to inhibit complement as indicated by a lower $ED_{50}$ (e.g., between 173 nM and 1.028 µM).

TABLE 19

C3 inhibition in human plasma

| Chymotrypsin numbering | SEQ ID NO.* | ED$_{50}$ 80% human plasma (60 min, nM) |
|---|---|---|
| wild type u-PA (protease domain) with C122S | 5 | >6000 |
| F30Y/V38D/Y40H/V41R/L97bA/H99Q/C122S/M157K | 8 | 1028 |
| F30Y/R35W/R36H/H37E/V38E/T39W/Y40H/V41R/Y60bQ/T97aE/L97bA/H99Q/C122S/Y149K/M157K | 9 | 257 |
| F30Y/R35W/R36H/H37D/V38E/T39Y/Y40F/V41R/T97aI/L97bA/H99Q/C122S/Y149R/M157K | 10 | 195 |
| R35W/R36H/H37N/V38E/T39F/Y40F/V41R/T97aI/L97bA/H99Q/C122S/Y149R/M157K/Q192H | 11 | 208 |
| F30Y/R35Y/R36H/H37K/V38E/T39F/Y40F/V41R/T97aI/L97bA/H99Q/C122S/Y149R/M157K | 12 | 227 |
| F30Y/R35W/R36H/H37N/V38E/T39Y/Y40F/V41R/Y60bS/T97aE/L97bA/H99Q/C122S/Y149K/M157K | 13 | 220 |
| F30Y/R35W/R36H/H37P/V38E/T39Y/Y40F/V41R/Y60bS/T97aE/L97bA/H99Q/C122S/Y149K/M157K | 14 | 185 |
| F30Y/R35Q/R36H/H37G/R37aE/V38E/T39F/Y40F/V41R/D60aP/Y60bS/T97aI/L97bA/H99Q/C122S/Y149R/M157K | 16 | 220 |
| F30Y/R35Y/R36H/H37P/R37aQ/V38E/T39Y/Y40F/V41R/Y60bH/T97aI/L97bA/H99Q/C122S/Y149R/M157K | 17 | 173 |
| R35Q/H37Y/R37aE/V38E/T39Y/V41R/D60aT/Y60bT/T97aI/L97bA/H99Q/C122S/Y149R | 18 | 253 |
| R35W/H37P/R37aN/V38E/T39Y/V41R/D60aP/Y60bL/T97aI/L97bA/H99Q/C122S/Y149R | 19 | 318 |
| R35W/H37D/R37aP/V38E/T39W/V41R/Y60bA/T97aI/L97bA/H99Q/C122S/Y149R | 20 | 196 |

*SEQ ID the of exemplary protease domain containing the replacements

Example 7

Kinetic Analysis of Plasminogen Activation Using an Indirect Chromogenic Assay An indirect chromogenic assay was performed to determine the activities of the wild-type and modified u-PA polypeptides produced as purified protein preparations (see, Madison et al. (1989) Nature, 339: 721-724; Madison et al. (1990) J Biol. Chem., 265: 21423-21426). In this assay, free p-nitroaniline is released from the chromogenic substrate Spectrozyme PL (H-D-norleucylhexahydrotyrosyl-lysine-p-nitroanilide diacetate salt, American Diagnostics, Inc.) by the action of plasmin generated by the action of u-PA on plasminogen. The release of free p-nitroaniline was measured spectrophotometrically at $OD_{405}$ nm.

For the assay, 100 μL reaction mixtures containing 0.25-1 ng of the u-PA enzymes to be tested, 0.62 mM Spectrozyme PL, and 0.2 μM Lys-plasminogen (American Diagnostics, Inc.), were combined in a buffer containing 50 mM Tris-HCL (pH 7.5), 0.1 M NaCl, 1.0 mM EDTA and 0.0100 (v/v) Tween 80. The reaction was incubated at 37° C. in 96-well, flat-bottomed microtiter plates (Costar, Inc.) and the optical density at 405 nm ($01D_{405}$) was read every 30 s for 1 hour in a Molecular Devices Thermomax. The kinetic constants $k_{cat}$, $K_m$, and $k_{cat}/K_m$ (specificity constant) were calculated (see, e.g., Madison, E. L (1989) Nature 339: 721-724).

The results are set forth in Table 20 below. The results show that the modified u-PA polypeptides have significantly decreased enzymatic activity for the substrate plasminogen. All of modified u-PA polypeptides provided herein have reduced activity on and specificity for plasminogen; and all have many-fold increases in specificity and activity on C3, and for inhibiting complement activation compared to the unmodified n-PA

TABLE 20

| Kinetic Analysis of Plasminogen Activation | | |
|---|---|---|
| Chymotrypsin numbering | SEQ ID NO.* | $k_{cat}/K_m$ ($M^{-1}s^{-1}$) |
| wild type u-PA with C122S | 5 | 1.54E+04 |
| F30Y/V38D/Y40H/V41R/L97bA/H99Q/C122S/M157K | 8 | 4.03E+02 |
| F30Y/R35W/R36H/H37E/V38E/T39W/Y40H/V41R/Y60bQ/T97aE/L97bA/H99Q/C122S/Y149K/M157K | 9 | <1.0E+01 |
| F30Y/R35Y/R36H/H37K/V38E/T39F/Y40F/V41R/T97aI/L97bA/H99Q/C122S/Y149R/M157K | 12 | <1.0E+01 |
| R35Q/H37Y/R37aE/V38E/T39Y/V41R/D60aT/Y60bT/T97aI/L97bA/H99Q/C122S/Y149R | 18 | <1.0E+01 |
| R35W/H37D/R37aP/V38E/T39W/V41R/Y60bA/T97aI/L97bA/H99Q/C122S/Y149R | 20 | <1.0E+01 |
| F30Y/R35Y/R36H/H37P/R37aQ/V38E/T39Y/Y40F/V41R/Y60bH/T97aI/L97bA/H99Q/C122S/Y149R/M157K | 17 | <1.0E+01 |

*SEQ ID the of exemplary protease domain containing the replacements

Example 8

Anti-C3 Activity and Stability of Anti-C3 u-PA Variant in Cynomolgus Monkey Vitreous Humor In Vivo The in vivo activity and stability of the modified u-PA polypeptide set forth in SEQ ID NO:21, which is the protease domain that contains the replacements R35Q/H37Y/R37aE/V38E/T39Y/V41R/D60aP/Y60bQ/T97aI/L97bA/H99Q/C122S/Y149R was assessed. Stability in vitreous humor and ability to cleave C3 are parameters indicative of a candidate for treatment of AMD.

Twelve naive cynomolgus monkeys were assigned to a single treatment group. Study animals were intravitreally administered a single dose 125 μg of modified u-PA polypeptide in one eye. The isolated protease domain whose sequence is set forth in SEQ ID NO:21, which has a molecular weight of approximately 25 kDa, was administered. The right eye received the test article and the left eye was injected with vehicle control. Four animals were sacrificed at each of the following time points: 24 hours post-dose, day 2 and on day 6. Vitreous humor samples were collected from the right and left eyes and analyzed for modified u-PA polypeptide stability and level of C3 after treatment with modified u-PA polypeptide or vehicle control; C3 and modified u-PA polypeptide concentration were determined by ELISA as detailed above.

The concentration of the modified u-PA polypeptide present in vitreous humor samples obtained 24 hours post-dose, on day 2 and on day 6 was determined by ELISA. The activity of the modified u-PA polypeptides was then quenched by the addition of EGR-CMK (Haematologic Technologies, EGRCK-01) to a final concentration of 10 μM and the hC3/modified u-PA polypeptide mixture was allowed to stand for 30 minutes at ambient temperature.

The half-life of modified u-PA polypeptide of SEQ ID NO:21 was determined to be approximately 2 days, which should correspond to approximately 5 days in a human system (Deng et al. MAbs 3(1): 61-66 (2011)). In vivo recovery (i.e., the peak level of modified u-PA polypeptide divided by the dose of modified u-PA polypeptide) of the modified u-PA polypeptide (of SEQ ID NO:21) was calculated by ELISA from the observed maximum level of modified u-PA polypeptide. The theoretical predicted value for 100% in vivo recovery was 2.5 μM. The measured in vivo recovery of modified u-PA protease domain (SEQ ID NO: 21) containing the replacements: R35Q/H37Y/R37aE/V38E/T39Y/V41R/D60aP/Y60bQ/T97aI/L97bA/H99Q/C122S/Y149R was calculated to be approximately 80% of the predicted value, or approximately 2.0 μM.

C3 levels in vitreous humor were assessed by ELISA as detailed in Example 3. C3 levels in vehicle-injected negative control eye ranged between 0.4 nM-50 nM (2 samples from vehicle-injected eyes differed significantly from the other 10, likely due to blood contamination of the vitreous). The baseline level of C3 prior to u-PA administration was approximately 2.2 nM. C3 was undetectable in variant-treated eye after 1 day and 7 days. After 28 days, C3 concentration in the eye treated with the modified u-PA polypeptide with the sequence set forth in SEQ ID NO: 21 was approximately 2.2 nM, which is equivalent to before-treatment levels. Thus, modified u-PA polypeptides provided herein are candidates for treatment of AMD.

Example 9

Exemplary Mutations in u-PA and Confirmation of Cleavage Sites

Exemplary positions and mutations in u-PA polypeptides, including the full-length, precursor and protease domains and catalytically active portions thereof are set forth in Table 22 (below).

TABLE 22

Exemplary mutations in u-PA

| Chymo numbering | Mature numbering | wt | Mutation in the polypeptide of SEQ ID NO: 21 | Exemplary mutations | Conservative to Mutations |
|---|---|---|---|---|---|
| 30 | 173 | F | | Y, | W, F |
| 35 | 178 | R | Q | Q, W, Y | Y, W, F, N |
| 36 | 179 | R | | H | N, Q |
| 37 | 180 | H | Y | Y, E, P, D, N, G, K, Y | D, E, Q, H, P, R, Q, E, W, F |
| 37a | 181 | R | E | E, P, Q, N | D, Q, H |
| 38 | 185 | V | E | E | |
| 39 | 186 | T | Y | W, Y, F | M, L |
| 40 | 187 | Y | | Q, F | M, L, Y, N, Q |
| 41 | 188 | V | R | R, L | K |
| 60a | 208 | D | P | P | S |
| 60b | 209 | Y | Q | L, Q, S, A, Y, T | N, T, G, S, I, V, Q |
| 97a | 249 | T | I | E, I | D, L, V |
| 97b | 250 | L | A | A, G | G, S |
| 99 | 252 | H | Q | Q | N |
| 149 | 306 | Y | R | K, R | Q, E |
| 157 | 314 | M | | K | R, Q, E |
| 192 | 353 | Q | | H | N, Q |

The replacements are in any form of u-PA, including the protease domain (SEQ ID NO: 2 or 5); the full length (SEQ ID NO: 1 or 4) and mature form (SEQ ID NO: 3 or 6). The replacements can be combined, including as exemplified herein, including up to as many as 15-18 or more replacements.

The data show that the modified u-PA polypeptides with these mutations, cleave and inactivate C3 in multiple species such as human and cynomolgus monkey. Cleavage of human C3 can be between residues 740 and 741 (SEQ ID NO:47), and this cleavage inactivates C3:

```
Q  H  A  R ↓ A   S  H  L         737-744
P4 P3    P1 ↓ P1'       P4'.
```

As demonstrated above, and throughout the disclosure, the modified u-PA polypeptides cleave and inactivate C3. The modified u-PA polypeptides were selected for cleavage in this region, and it was confirmed by testing them. For example, C3 was incubated with either modified u-PA protease domain (SEQ ID NO: 21) containing the replacements: R35Q/H37Y/R37aE/V38E/T39Y/V41R/D60aP/Y60bQ/T97aI/L97bA/H99Q/C122S/Y149R or with the modified u-PA protease domain (SEQ ID NO:40) with the replacements Y40Q/V41L/L97bA/C122S at enzyme to substrate ratios of 1:10 or 1:50 for a total of one hour. Samples were removed from these reactions at 0, 5, 10, 20, 40, and 60 minutes, and the cleavage reaction was terminated immediately in each sample by addition of TFA and flash freezing in dry ice. Prior to further analysis of these samples, cysteine side chains were reduced and alkylated, the F-amino group of lysine side chains was blocked by treatment with O-methylisourea, and peptide amino termini were then labeled with NHS-SS-biotin. The resulting biotinylated C3 peptides were captured and further digested with trypsin and GluC protease. Following this second protease digestion, peptide products were once again affinity captured. Biotin was then removed from the captured peptides by reduction, and the peptide mixture was analyzed by LC-MS/MS. At each time point after 0 minutes a fragment of MW 8289 was observed, indicating cleavage at the arginine in the QHAR site in C3. No additional C3 cleavage sites were observed in these reactions. Hence the modified u-PA polypeptides provided herein cleave at the QHAR.

```
Q  H  A  R ↓ A   S  H  L         737-744
P4 P3 P2 P1↓ P1'       P4'.
```

Example 10 u-PA Toxicity in Cynomolgus Monkey Vitreous Humor

Safety and tolerability of modified u-PA polypeptides were assessed in vivo in cynomolgus monkeys. Three naive cynomolgus monkeys were assigned to each of three treatment groups. Study animals were intravitreally administered either 12.5 μg, 37.5 μg or 125 μg per eye, of each modified u-PA polypeptide. The right eye received the test polypeptide and the left eye was injected with vehicle control. Animals were clinically observed (i.e., food consumption) and ophthalmic examinations were conducted. Ophthalmic examination included slit-lamp biomicroscopy and indirect ophthalmoscope observations, followed by color fundus photography or optical coherence tomography (OCT) prior to dosing (T=0) and on days 2, 8 and 15 post-dosing. All observations continued for up to 4 weeks or until resolution.

The no-observed-adverse-effect-level (NOAEL) was assessed for all animals. The NOAEL for animals administered a modified u-PA polypeptide with the sequence set forth in SEQ ID NO: 42 was ≥37.5 μg. No adverse effects were noted for animals administered a modified u-PA polypeptide with the sequence set forth in SEQ ID NO: 21; therefore, the NOAEL for animals administered a modified u-PA polypeptide with the sequence set forth in SEQ ID NO: 21 was ≥125 μg (equivalent to ≥375 μg/eye in man).

Example 11

Calculations were performed to identify candidate immunogenic hotspots in the wild-type u-PA, a C122S variant of wild-type u-PA (SEQ ID NO:5) protease domain and exemplary u-PA variant protease domains to confirm that the mutations in the exemplary variants did not introduce any immunogenic hotspots. Calculations also were performed to compare the overall profile of hotspots for the variants of interest to a panel of comparison proteins.

Overview of Methods

An important step in the T-cell response to foreign proteins is the binding and presentation of constituent peptides (derived from the cleavage of the foreign protein) to any of a host of HLA complexes expressed in the antigen presenting cells. The identification of peptides, derived from a protein, that are predicted to bind to known HLAs can be used as an indication of possible hotspots in the sequence for eliciting a T-cell response. When considering a variant of a protein with known immunogenic properties, comparing the profile of predicted HLA-binders can help to identify whether the changes introduced any new immunogenic hotspots.

The profiles can be generated using publically available databases. For example, the publically available binding prediction service (NetMHCII 2.2server), Technical University of Denmark, was used to predict binding to HLAs. The NetMHCII 2.3 server predicts binding of peptides to HLA-DR, HLA-DQ, HLA-DP and mouse MHC class II alleles using artificial neuron networks. Predictions can be obtained for 25 HLA-DR alleles, 20 HLA-DQ, 9 HLA-DP, and 7 mouse H2 class II alleles. The prediction values are given in nM $IC_{50}$ values, and as a %-Rank to a set of 1,000,000 random natural peptides. Strong and weak binding peptides are indicated in the output.

The service was used to predict the binding affinity of all possible peptides of 15 contiguous amino acids in exemplary variants (SEQ ID NO:40, and SEQ ID NO:21), the wild-type protease domain (SEQ ID NO:2), and wild-type protease domain with C122S (SEQ ID NO:5) against a panel of 14 HLA-DR variants (see Table B, below) based on the primary sequence of the peptide. For each peptide/HLA pair, the NetMHCII server provides a predicted binding affinity, as well as a classification as a tight binder ($K_d \leq 500$), weak binder $K_d \leq 50$ nM), or non-binder ($K_d > 500$ nM). For a protein sequence containing N amino acids, this results in a total of $T=(N-14) \times 14$ possible peptide-HLA binding pairs.

Using the binding predictions from the NetMHCII server, the results were used to identify possible hotspots in these protein sequences, based on areas where a number of candidate binding pairs were identified. These changes were compared with the known changes in the corresponding protein sequences.

For each protein, an overall binding score based on the number of predicted tight-binding peptide-HLA pairs (TB), the number of predicted weak-binding peptide-HLA pairs (WB), and the total number of peptide-HLA pairs considered (T) as:

Score=(TB+0.5*WB)/T

Table B—HLA-DR Molecules Included as Possible Binders
HLA-DRB1*1101
HLA-DRB1*0101
HLA-DRB1*0301
HLA-DRB1*0401
HLA-DRB1*0404
HLA-DRB1*0405
HLA-DRB1*0701
HLA-DRB1*0802
HLA-DRB1*0901
HLA-DRB1*1302
HLA-DRB1*1501
HLA-DRB3*0101
HLA-DRB4*0101
HLA-DRB5*0101

This score has shown good agreement with the in silico immunogenicity predictions generated by the company EpiVax (Providence, R.I.), which uses immunoinformatics and in vitro techniques to predict immunogenicity, when using a subset of 8 HLAs. This subset of 8 HLAs was used. The same calculations were performed on a panel of standard proteins to provide a comparison set against which to compare the u-PA variants.

Impact of Mutations on Predicted HLA Binding Profiles

The number of times a given sequence position for any of the variant u-PA protease domains were mapped for each-HLA complex at a $K_d$ cutoff of 50 nM and 500 nM. The scale in each column is fixed, but differs between columns and compared with the wild-type polypeptides to assess whether the mutations altered the immunogenic profile. No significant differences among the polypeptides were observed.

Aggregate Immunogenicity Scores

To compute an aggregate immunogenicity score for each sequence, the total number of peptide-HLA binding pairs at each binding threshold across a panel of 8 HLAs (Table C) that previously have been validated by EpiVax (Providence, R.I.) to provide good agreement with published in silico immunogenicity scores. EpiVax is a company that uses immunoinformatics and in vitro techniques to predict immunogenicity. These values then were used to compute an overall score as described in the methods summary above.

TABLE C

| HLA-DR subset used for overall immunogenicity score |
|---|
| HLA-DRB1*0101 |
| HLA-DRB1*0301 |
| HLA-DRB1*0401 |
| HLA-DRB1*0701 |
| HLA-DRB1*0802 |
| HLA-DRB1*1101 |
| HLA-DRB1*1302 |
| HLA-DRB1*1501 |

The number of peptide-HLA binding pairs for the subset of 8 HLAs and the composite scores for uPA are shown below:

| Sequence ID | # tight (TB) | # weak (WB) | Total possible (T) | Score |
|---|---|---|---|---|
| 2 (WT) | 98 | 526 | 1888 | .191 |
| 5 (WTS) | 109 | 542 | 1888 | .201 |
| 40 | 107 | 528 | 1912 | .194 |
| 21 | 96 | 514 | 1912 | .185 |

The results indicate that the immunogenicity of the variants should not be different from the wild-type polypeptides. The results of the same analysis for a panel of comparator proteins is shown below:

| Sequence | # tight (TB) | # weak (WB) | Total possible (T) | Score |
|---|---|---|---|---|
| Follitropin-Beta | 13 | 120 | 920 | .079 |
| Fibrinogen-Alpha | 125 | 582 | 5040 | .083 |
| Insulin | 32 | 107 | 768 | .111 |
| Albumin | 192 | 743 | 4760 | .118 |
| Amylase | 210 | 711 | 3976 | .142 |
| Thrombopoietin | 266 | 609 | 2712 | .210 |
| Interferon-Beta | 175 | 353 | 1384 | .254 |
| Interleukin-11 | 233 | 316 | 1480 | .264 |

Example 12

Activation of Plasminogen by wt- and Variant u-PA Polypeptides

The catalytic efficiency for activation of Glu-plasminogen by wt- and anti-C3 variants of u-PA polypeptides provided herein was tested as described below. Data from these experiments demonstrated that the anti-C3 u-PA variant proteins displayed significantly reduced activity towards plasminogen, a physiologically relevant substrate of wild type u-PA. In combination with data from Example 7, these data demonstrate that the anti-C3 u-PA polypeptides display not only substantially greater activity towards a "new" substrate, C3, but also substantially reduced activity towards the normal physiological substrate of wt u-PA.

Mutations introduced into the anti-C3 variants described in this application, therefore, have dramatically altered substrate specificity of the anti-C3 variant polypeptides compared with that of wt-u-PA.

Plasminogen Activation by Wt- and Anti-C3 Variant u-PA Polypeptides

1) Analysis Using a Single Time Point Reaction (37 C for 30 Minutes)

a) Reaction Conditions

Plasminogen activation activity was measured for wild type u-PA/C122S (SEQ ID NO:5) as well as anti-C3 u-PA polypeptide variants containing the mutations Y40Q/V41L/L97bA/C122S (SEQ ID NO:40) and R35Q/H37Y/R37aE/V38E/T39Y/V41R/D60aP/Y60bQ/T97aI/L97bA/H99Q/C122S/Y149R (SEQ ID NO:21). Protease concentrations in the reaction mixture were 25 nM (wt–u=PA) or 250 nM (anti-C3 u-PA variant) and substrate (i.e, Glu-plasminogen) concentration was 2.5 uM. The reaction volume was 20 uL and the reaction proceeded for 30 minutes at 37° C. Each reaction was terminated by adding of 2 uL of 1 M DTT and 7 uL of 4× sample buffer, and heating to 80° C. for 45 s. Terminated reaction mixtures were loaded into individual wells of a 4-12% BIS-TRIS gel and run in XT MES buffer at 200 V for 45 min and then stained with SimplyBlue SafeStain.

b) Measurement of Reaction Product (i.e., plasmin)

Analysis of the stained SDS gel indicated that wt u-PA cleaved all the plasminogen present in the reaction, converting it to two-chain, active plasmin during the 30 minute incubation. By contrast, the activity of u-PA variant Y40Q/V41L/L97bA/C122S (seq ID 40) in this reaction was substantially lower than that of wt-u-PA while no plasminogen activation was observed by u-PA variant R35Q/H37Y/R37aE/V38E/T39Y/V41R/D60aP/Y60bQ/T97aI/L97bA/H99Q/C122S/Y149R in this reaction.

2) Kinetics of Glu-Plasminogen Activation by anti-C3 u-PA Polypeptides Kinetic analysis of the activation of Glu-plasminogen by wt- or anti-C3 uPA variant polypeptides was performed as described below. Activation reactions were performed at 37° C. in an I=0.16 M Hepes/NaCl/EDTA buffer containing 0.1% BSA. U-PA polypeptides were present at concentrations of 1 (wt) or 10 (variant) nM. Second-order rate constants ($k_{cat}$/KM) were derived from the fitted linear relationship of the initial reaction velocities for hydrolysis (by the reaction product plasmin) of the chromogenic substrate S-2251 (H-D-Val-Leu-Lys-pNA·2HCl) vs. the Glu-plasminogen (i.e., u-PA substrate) concentration (0-4 μM). See also Table 24:

| SEQ ID NO. | Mutations | $k_{cat}/K_M$ ($M^{-1}s^{-1}$) | ±S.D. | % CV | n= | Ratio to WT |
|---|---|---|---|---|---|---|
| 5 | C122S (WT) | 2.28E+04 | 2.62E+03 | 11.5% | 4 | 1 |
| 423 | V38D/L97bA/H99Q/C122S | 1.38E+03 | 1.79E+02 | 12.9% | 4 | 17 |
| 8 | F30Y/V38D/Y40H/V41R/L97bA/H99Q/C122S/M157K | 4.59E+02 | 6.42E+01 | 14.0% | 4 | 50 |
| 254b* | C[4]S/F30Y/R35W/R36H/H37E/V38E/T39W/Y40H/V41R/Y60bH/T97aI/L97bA/H99Q/C122S/Y149R/M157K/Q192A | 9.91E−01 | 1.88E+00 | 190.0% | 4 | 23034 |

C4S mutation is not in the protease domain

Comparison among 15 variants showed the results in the Table 24 appended below labeled "Activation of Glu-Plasminogen by anti-C3 u-PA Variants."

For Table 24:

Glu-plasminogen was activated by C122S uPA or selected uPA variants at protease concentrations of 1 nM or 10 nM protease;

Reactions were carried out at 37° C. in an I=0.16 M Hepes/NaCl/EDTA buffer containing 0.1% BSA.

Second-order rate constants (kcat/KM) were derived from the fitted linear relationship of the initial reaction velocities for hydrolysis of the chromogenic substrate S-2251 (H-D-Val-Leu-Lys-pNA·2HCl) vs. the Glu-plasminogen concentration (0-4 μM).

Example 13

Exemplary u-PA Protease Domain Mutants Cleavage of Complement Protein C3 in Cynomolgus Monkey Vitreous Humor Exemplary mutants are shown in FIG. 5 with reference to the WT u-PA protease domain set forth in SEQ ID NO: 5. Cells with thin borders indicate that the modified u-PA polypeptides are mutated at this residue when compared to the reference u-PA polypeptide set forth in SEQ ID NO: 5. Cells with thick borders indicate that the modified u-PA polypeptides contain the same amino acid as the reference u-PA polypeptide set forth in SEQ ID NO: 5. The activity of the modified u-PA polypeptides was determined by cleavage of the substrate complement protein C3 as detailed and presented in Example 2 and are presented as the residual levels of C3 (nM) after u-PA treatment. Cleavage of C3 by the modified u-PA polypeptides was performed in purchased cynomolgus monkey vitreous humor or Phosphate Buffered Saline (PBS) control as detailed in Example 3. The results set forth in FIG. 5, show that the modified u-PA polypeptides exhibit greater activity against C3 compared to the reference u-PA protease domain, whose sequence is set forth in SEQ ID NO:5. The activity % in vitreous humor and PBS show the percentage of remaining activity after 7 days. The modified u-PA polypeptides are relatively stable compared to the reference wild-type protease domain of SEQ ID NO:5, with some showing more stability than others. Therapeutic candidates, including those in the table below, are those having high C3 cleavage activity, and greater stability, particularly in vitreous humor.

Among other things, these data and the other data show that:

R35Q: this mutation increased the intrinsic anti-C3 activity (i.e., in buffer) by approximately 2.7-fold and by approximately 4.3-fold in the presence of 80% human plasma H37Y: this mutation increased anti-C3 activity by approximately 2.4-2.5-fold in buffer and in the presence of 80% human plasma R37aE: this mutation decreased the intrinsic anti-C3 activity by approximately 3.2-fold; however, in the presence of 80% human plasma it had no effect on anti-C3 activity V38E: this mutation improved the stability of the protein in buffer and vitreous humor and improved the anti-C3 activity in 80% human plasma by ~1.5-fold T39Y: This mutation increased the intrinsic anti-C3 activity and the anti-C3 activity in 80% human plasma by approximately 7.5-8.5-fold V41R: This mutation increased the intrinsic anti-C3 activity and the anti-C3 activity in 80% human plasma by approximately 25-27-fold D60aP: This mutation increased the intrinsic anti-C3 activity and the anti-C3 activity in 80% human plasma by approximately 1.2-1.6-fold Y60bQ: This mutation decreased the intrinsic anti-C3 activity by approximately 1.7-fold and decreased the stability of the protein in vitreous after incubation for 7 days at 37° C. by ~1.4-fold; but in the presence of 80% human plasma, it increased anti-C3 activity by approximately 1.1-fold T97aI: This mutation increased the intrinsic anti-C3 activity and anti-C3 activity in the presence of 80% human plasma by approximately 1.2-1.3-fold L97bA: This mutation increased anti-C3 activity by approximately 6.4-8.2-fold in buffer and in 80% human plasma H99Q: This mutation increased anti-C3 activity by approximately 2.9-4.8-fold in buffer and 80% human plasma Y149R: This mutation decreased anti-C3 activity by approximately 1.6-2.1-fold in buffer and 80% human plasma.

Similar results were achieved for the replacements in lower mutation load modified u-PA polypeptides that contain: I41D/C122S/G151N/Q192T (see, e.g., the modified u-PA polypeptide whose sequence is set forth in SEQ ID NO:40, and also full-length and precursor and mature forms that contain these replacements).

Data indicate that the modified u-PA provided herein cleave and inactivate C3 in a variety of species. For example, cleavage of human C3 to inactivate it can be between residues 740 and 741 (SEQ ID NO:47):

```
Q  H  A  R  ↓ A  S  H  L           737-744
P4 P3    P1 ↓ P1'      P4'.
```

Example 14

Cloning, Expression and Preparation of u-PA-Human Serum Albumin (HSA) Fusion Proteins A. Cloning of the u-PA-HSA Fusion Polypeptide A construct for expression of a u-PA-HSA fusion protein was generated (SEQ ID NO:1015). The u-PA-linker-HSA fragment was assembled from synthetic oligonucleotides and/or PCR products and cloned into the pcDNA3.4-TOPO vector (Invitrogen; Cat. No. A14697) for expression under control of the human cytomegalovirus (CMV) immediate-early promoter/enhancer or a proprietary expression vector (Lake Pharma). A secretion signal sequence (SEQ ID NO:999 (METDTLLLWVLLLWVPGSTG)) was cloned upstream of the u-PA N-terminal domain (amino acids 1-158 of SEQ ID NO: 3), and an exemplary modified u-PA protease domain (set forth in SEQ ID NO:987), and linked via a linker (SEQ ID NO: 1002 (GGSSGG)) to the coding region of human serum albumin (HSA; SEQ ID NO: 991):

```
DAHKSEVAHRFKDLGEENFKALVLIAFAQYLQQCPFEDHVKLVNEVT
EFAKTCVADESAENCDKSLHTLFGDKLCTVATLRETYGEMADCCAKQ
EPERNECFLQHKDDNPNLPRLVRPEVDVMCTAFHDNEETFLKKYLYE
IARRHPYFYAPELLFFAKRYKAAFTECCQAADKAACLLPKLDELRDE
GKASSAKQRLKCASLQKFGERAFKAWAVARLSQRFPKAEFAEVSKLV
TDLTKVHTECCHGDLLECADDRADLAKYICENQDSISSKLKECCEKP
LLEKSHCIAEVENDEMPADLPSLAADFVESKDVCKNYAEAKDVFLGM
FLYEYARRHPDYSVVLLLRLAKTYETTLEKCCAAADPHECYAKVFDE
FKPLVEEPQNLIKQNCELFEQLGEYKFQNALLVRYTKKVPQVSTPTL
VEVSRNLGKVGSKCCKHPEAKRMPCAEDYLSVVLNQLCVLHEKTPVS
DRVTKCCTESLVNRRPCFSALEVDETYVPKEFNAETFTFHADICTLS
EKERQIKKQTALVELVKHKPKATKEQLKAVMDDFAAFVEKCCKADDK
ETCFAEEGKKLVAASQAALGL.
```

The construct includes the signal peptide (amino acids 1-20), the u-PA N-terminal domain, the modified protease domain of SEQ ID NO:21, except with C at position 122 (set forth in SEQ ID NO: 987), the GS linker (GGSSGG, SEQ ID NO: 1002) followed by the HSA coding region. The complete construct sequence, set forth in SEQ ID NO: 1015, is:

```
METDTLLLWVLLLWVPGSTGSNELHQVPSNCDCLNGGTCVSNKYFSN
IHWCNCPKKFGGQHCEIDKSKTCYEGNGHFYRGKASTDTMGRPCLPW
NSATVLQQTYHAHRSDALQLGLGKHNYCRNPDNRRRPWCYVQVGLKP
LVQECMVHDCADGKKPSSPPEELKFQCGQKTLRPRFKIIGGEFTTIE
NQPWFAAIYQRYEGGSEYYRCGGSLISPCWVISATHCFIPQPKKEDY
IVYLGRSRLNSNTQGEMKFEVENLILHKDYSADIAAQHNDIALLKIR
```

-continued

SKEGRCAQPSRTIQTICLPSMYNDPQFGTSCEITGFGKENSTDRLYP

EQLKMTVVKLISHRECQQPHYYGSEVTTKMLCAADPQWKTDSCQGDS

GGPLVCSLQGRMTLTGIVSWGRGCALKDKPGVYTRVSHFLPWIRSHT

KEENGLALGGSSGGDAHKSEVAHRFKDLGEENFKALVLIAFAQYLQQ

CPFEDHVKLVNEVTEFAKTCVADESAENCDKSLHTLFGDKLCTVATL

RETYGEMADCCAKQEPERNECFLQHKDDNPNLPRLVRPEVDVMCTAF

HDNEETFLKKYLYEIARRHPYFYAPELLFFAKRYKAAFTECCQAADK

AACLLPKLDELRDEGKASSAKQRLKCASLQKFGERAFKAWAVARLSQ

RFPKAEFAEVSKLVTDLTKVHTECCHGDLLECADDRADLAKYICENQ

DSISSKLKECCEKPLLEKSHCIAEVENDEMPADLPSLAADFVESKDV

CKNYAEAKDVFLGMFLYEYARRHPDYSVVLLLRLAKTYETTLEKCCA

AADPHECYAKVFDEFKPLVEEPQNLIKQNCELFEQLGEYKFQNALLV

RYTKKVPQVSTPTLVEVSRNLGKVGSKCCKHPEAKRMPCAEDYLSVV

LNQLCVLHEKTPVSDRVTKCCTESLVNRRPCFSALEVDETYVPKEFN

AETFTFHADICTLSEKERQIKKQTALVELVKHKPKATKEQLKAVMDD

FAAFVEKCCKADDKETCFAEEGKKLVAASQAALGL.

B. Preparation of u-PA-HSA Fusion Polypeptides

1. Transformation and Expression of u-PA-HSA Fusion Polypeptides

DNA encoding the modified u-PA-HSA fusion polypeptide was cloned into the pcDNA3_4 expression vector (Thermo Fisher) or a proprietary vector (Lake Pharma) C-terminal to the secretion signal sequence as detailed in Section A. Modified u-PA-HSA fusion proteins were subsequently expressed in a 1 L volume of expression media for 6 days in HEK expi293 or expiCHO expression cells at ThermoFisher or the proprietary TunaCHO™ cell line at Lake Pharma.

2. Affinity Purification of u-PA-HSA Fusion Polypeptides

The zymogen form of the modified u-PA-HSA fusion proteins were purified using the system sold as the CaptureSelect™ Human Albumin Affinity Matrix system (ThermoFisher Scientific; Cat. No. 19129701L or 19127005) according to the manufacturer's instructions. A column was prepared by adding approximately 10 mL of CaptureSelect™ Affinity Matrices resin (ThermoFisher) to the column. After the storage solution was allowed to flow through the column, 10 column volumes (CVs) of PBS (137 mM NaCl, 2.7 mM KCl, 10 mM $Na_2HPO_4$, 2 mM $KH_2PO_4$, pH 7.4) was added to wash the resin. Next, the expression harvests containing the u-PA-HSA fusion proteins were applied to the column and subsequently washed with 5-10 CVs of PBS. Bound u-PA-HSA fusion proteins were eluted with 10 CVs of elution buffer (20 mM Tris, 2 M $MgCl_2$, pH 7.0). The column was later stripped with 10 CVs of glycine (0.2 M, pH 3.0) and neutralized with 10% Tris-HCl (1.5 M, pH 7.4) and re-equilibrated in PBS. Samples of flow through and elution steps were collected and analyzed on reduced and non-reduced SDS PAGE gel electrophoresis to evaluate sample purity. The u-PA-HSA fusion proteins were dialyzed for 16 hours into PBS at 4° C.

3. Plasmin Activation of Modified u-PA-HSA Fusion Polypeptides

Plasmin selectively cleaves a single bond in wild-type u-PA and other u-PA fusion polypeptides having the wild-type u-PA activation sequence to activate the u-PA-HSA zymogen and form a two-chain u-PA-HSA fusion protein, linked via a disulfide with the C-terminal active protease domain tethered to the N-terminal u-PA domain by a disulfide linkage. For these experiments the construct used has the sequence set forth in SEQ ID NO:1015, which contains the modified u-PA polypeptide of SEQ ID NO:21, except that the C122S, by chymotrypsin numbering, is C122C to provide a free cysteine, and the signal sequence (residues 1-20 of SEQ ID NO:1015) is not included. Following activation the resulting product has two chains (with reference to SEQ ID NO:1015): an A chain that has residues 21-178, and a B chain that has residues 179-1022, u-PA (residues 179-431), linker (residues 432-437), and HSA (residues 438-1022). The A and B chains are linked by a disulfide bond between C168 and C299 (corresponding to C122 by chymotrypsin numbering).

The HSA domain remains conjugated through the GGSSGG linker to the C-terminus of the protease domain. Activation followed the following procedure: a plasmin-agarose resin slurry (Molecular Innovations; Cat. No. HPL-1) was prepared by washing the resin with 1×PBS, 3 times. Subsequently, 200 µL of resin slurry in 1×PBS per milligram of u-PA fusion polypeptide was added to a solution containing the dialyzed u-PA-HSA fusion polypeptide in PBS. "Activation" of the u-PA polypeptide zymogen was accomplished by gently shaking the protein/resin solution for 3 hours at room temperature. The modified u-PA-HSA polypeptide zymogen was thenceforth fully converted into the corresponding active modified u-PA-HSA protease.

The activated modified u-PA-HSA polypeptides were recovered from the plasmin resin using 0.2 µm spin filters (2.0 mL capacity) and centrifuging to recover activated modified u-PA-HSA from the plasmin resin as per the manufacturer's instructions. To maximize recovery, additional filtration techniques may be envisioned (as opposed to spinning down the resin and recovering the supernatant by pipette extraction). Other low-protein binding filtration apparatus also can be used for further filtration of the resin. Activated u-PA-HSA fusion proteins were stored at 4° C. or frozen in aliquots. Confirmation of the complete activation step was visualized by SDS-PAGE under reducing conditions to separate the N-terminal domain from the protease domain HSA fusion conjugate.

4. Inhibition of Activated Modified u-PA-HSA Fusion Proteins

For some experiments it was desired to use a catalytically inactive form of the u-PA-HSA fusion polypeptide (set forth as residues 21-1022 of SEQ ID NO:1015, as discussed above; see e.g., SEQ ID NO: 1019). To generate a protein designated as inhibited modified u-PA-HSA (u-PA-HSAi), activated modified u-PA-HSA (u-PA-HSAa) was incubated with an irreversible active site inhibitor, Glu-Gly-Arg-Chloromethylketone (EGR-CMK), to prevent any autocatalysis of the modified u-PA-HSA polypeptides or inactivation/cleavage during in vivo experiments (see e.g., Examples 15 and 16). To prepare the u-PA-HSAi, lyophilized EGR-CMK (Molecular Innovations; Cat. No. GGACK) was reconstituted to 100 mM in 10 mM HCl. Concentrated EGR-CMK was added to the activated modified u-PA-HSA sample (u-PA-HSAa) at the stock concentration to reach a final inhibitor concentration of 1 mM EGR-CMK inhibitor in 1×PBS, and the mixture was allowed to incubate for 1 hour at RT.

To assess whether the u-PA-HSAa was fully inhibited, the degradation of modified u-PA-HSAi was compared to modified u-PA-HSAa in a stability experiment. Briefly, modified u-PA-HSAi and modified u-PA-HSAa were incubated for 0 hours, 1 day, or 7 days at 37° C. Modified u-PA-HSAi and u-PA-HSAa degradation was visually monitored by reduced and non-reduced SDS-PAGE gel electrophoresis under reduced and non-reduced conditions. Bands were visualized by Comassie or other similar commercially available stain. The results demonstrate that preincubation with the inhibitor stabilizes the polypeptide, as no degradation products were observed for the modified u-PA-HSAi at any time point up to 7 days, compared to the observed degradation of modified u-PA-HSAa after incubation for 1 day or 7 days at 37° C.

5. Purification of u-PA-HSAa and u-PA-HSAi Polypeptides after Activation

During the final purification round, active and inhibited modified u-PA-HSA polypeptides were isolated from high and low molecular weight impurities using size exclusion chromatography. Purification excluded a high molecular weight species that eluted as a discrete peak prior to the main u-PA-HSA peak. The high molecular weight species was not further analyzed, however could represent aggregates or multimers that formed during the expression or activation steps in the process. A secondary, low molecular weight species thought to be free from albumin generated during expression or activation was also eliminated.

Purification proceeded as follows: a ~300 μL sample of modified u-PA-HSAi (0.8 mg) or a ~400 μL sample of modified u-PA-HSAa (0.8 mg) was loaded onto a size-exclusion chromatography column (HiPrep 16/60 Sephacryl S-200 HR; GE Healthcare, Cat. No. GE17-1166-01) in PBS at pH 7.0 at a flow rate of 0.5 mL/min. Proteins were generally purified according to manufacturer instructions for the resin (GE Healthcare) with the main peak containing modified u-PA-HSAi or u-PA-HSAa retained.

The quality of the preparations and extent of separation was further assessed by reducing and non-reducing SDS-PAGE gel electrophoresis. Elution fractions of modified u-PA-HSAi or u-PA-HSAa polypeptide sample were loaded in each "lane" of a 12-well non-reducing SDS-PAGE gel and run at 40V until the bands were sufficiently distinguishable and the various sized protein species were visualized by silver staining to improve sensitivity over the standard Coomassie stain. Fractions containing single bands migrating at the expected molecular weight of 75 kDa were pooled and snap-frozen in liquid nitrogen at a final concentration of approximately 2 mg/mL and stored at −80° C. until use. The final concentration was determined by absorption at 280 nM using a NanoDrop spectrophotometer. Protein size and expression was later confirmed by Comassie stain, and SDS-PAGE. The quality of individual u-PA-HSA polypeptide samples was further assessed by activity assays and mass spectroscopy.

Example 15

Modified u-PA Protease Domain and Modified u-PA-HSA Fusion Protein Pharmacokinetic Evaluation Following Intravitreal Injection The pharmacokinetics and overt ocular toxicity of a modified u-PA-HSA fusion polypeptide was assessed. The fusion protein contains ae modified u-PA polypeptide protease domain (SEQ ID NO:987, which is SEQ ID NO:21, except that the C122S is C122C), as described above in Example 14. The fusion protein has the sequence set forth in SEQ ID NO:1019, which is residues 21-1022 of SEQ ID NO:1015. As described in Example 14, the protease domain of the modified u-PA is set forth in SEQ ID NO:987. The pharmacokinetic profile of activated and inhibited modified u-PA-HSA fusion proteins (SEQ ID NO:1015) were assessed in vivo in Dutch Belted rabbits and compared to that of the pharmacokinetic profile of the modified u-PA protease domain only as set forth in SEQ ID NO:21. Eight rabbits were assigned to each of three treatment groups (group 1: modified u-PA-HSAa; group 2: modified u-PA-HSAi; group 3: modified u-PA protease domain (SEQ ID NO: 21)). Study animals were administered 50 μL of either 2.1 mg/mL of modified u-PA-HSAi and u-PA-HSAa, or 1.15 mg/mL of modified u-PA (SEQ ID NO: 21), per eye, via intravitreal injection (IVT). For the group treated with the modified u-PA containing the modified protease, the right eye received the modified u-PA polypeptide, and the left eye was injected with PBS as the vehicle control (PBS). The table below summarizes the groups and conditions, and assessments performed:

| Group | Formulation | Concentration (mg/mL) | Dose/Route | Irritation scoring method/timing | Terminal Time points | Fluids and Tissues Collected (OS and OD)* |
|---|---|---|---|---|---|---|
| 1 (n = 8) | modified u-PA-HSA Activated (u-PA-HSAa) | 2.1 mg/mL | 50 μL/eye intravitreal | Draize/prior to euthanasia | 1, 3, 7, and 14 days post-dose (n = 2/time point) | Aqueous humor, vitreous humor, retina, choroid, plasma |
| 2 (n = 8) | modified u-PA-HSA Inhibited (u-PA-HSAi) | 2.1 mg/mL | 50 μL/eye intravitreal | Draize/prior to euthanasia | 1, 3, 7, and 14 days post-dose (n = 2/time point) | Aqueous humor, vitreous humor, retina, choroid, plasma |
| 3 (n = 8) | Modified u-PA Protease Domain (SEQ ID NO: 21) | 1.15 mg/mL | 50 μL left eye/intravitreal Right eye/control | Draize/prior to euthanasia | 1, 3, and 7 days postdose (n = 2-3/timepoint) | Aqueous humor, vitreous humor, retina, choroid, plasma |

*OS and OD refer to the right and left eyes, respectively

1. Modified u-PA and Modified u-PA-HSA Fusion Protein Ocular Tolerability

During the dosing period and prior to euthanasia, clinical and ocular observations were conducted and body weight were recorded. Ocular exams were performed on both eyes at 1, 3, 7, and 14 days (Groups 1 and 2) or at 1, 3, and 7 days (Group 3) following dosing, and ocular irritation was scored using the Draize scale. The Draize scoring system (Draize et al., (1944) *J Pharm Exper Ther* 82 (3) 377-90) assesses eye irritation in the cornea, iris and conjunctiva and provides criteria for scoring irritation on a 0-2 or 0-4 scale. A score of "0" indicates that the cornea, iris or conjunctiva is normal. At all timepoints, ocular irritation was scored a 0 as assessed using the Draize criteria for all animals except one rabbit with 2 scores of "1" indicating "redness" where the "vessels are definitely injected above normal" and "chemosis" with "swelling above normal" of the conjunctiva. These "1" scores were observed for one rabbit in Group 2 (u-PA-HSAi) within a few hours following the intravitreal administration of u-PA-HSAi at day 1. Most importantly there was no toxicity observed after intravitreal administration of the modified u-PA and modified u-PA-HSA activated fusion proteins.

2. Modified u-PA and Modified u-PA-HSA Fusion Protein Pharmacokinetics

For the determination of modified u-PA and modified u-PA-HSA polypeptide concentrations (nM) and pharmacokinetic parameters, terminal samples of ocular tissues and fluids were collected after enucleation of both eyes on days 1, 3, 7 and 14 using two animals per time point. Following euthanasia, both eyes of each rabbit were harvested and dissected for collection of ocular tissues and fluids (aqueous humor (AH), vitreous humor (VH), retina, and choroid)) for assessment of u-PA and u-PA-HSA expression and activity. Following collection, weighed amounts of rabbit vitreous humor, retina, and choroid were homogenized in impact resistant microtubes (USA Scientific) containing 2.8 mm ceramic beads. For VH, retina, and choroid tissues, a consistent aliquot of phosphate buffered saline per milligram of tissue was added to each tube. Retina and choroid samples were diluted 9:1 (diluent volume:tissue volume) and VH samples were diluted 4:1 (diluent volume:VH volume) with phosphate buffered saline. Samples were homogenized (Precellys® homogenizer) at 0 to 10° C., at 5500 rpm for 3×30 second cycles with 20 second pauses between cycles until thoroughly homogenized.

The concentration as determined by ELISA (nM) and activity (nM) of modified u-PA and modified u-PA-HSA polypeptides in VH was determined using an ELISA and activity assay, respectively. For the concentration determination, the anti-u-PA sandwich ELISA was carried out as follows: the capture antibody PA1-36166 (Invitrogen) was coated on ELISA plates overnight at 4° C. or 2 hours at RT at a concentration of 1.0 ug/mL in 100 mM carbonate buffer, pH 9.5. The plates were subsequently washed 3× with PBST (1×PBS containing tween) followed by blocking with 1% BSA in PBS-tween overnight at 4° C. or 2 hours at RT. 50 μL of each sample were incubated for 30 mins at RT with shaking followed by washing 3× with PBS and incubation with the detection antibody PA1-36015 (Invitrogen at 0.25 ug/mL for 30 mins). Wells were again washed and subsequently incubated with HRP conjugated anti Goat antibody (Rockland) at 1:30,000 dilution for 30 min with shaking at RT. After washing 6× with PBST, bound modified u-PA and modified u-PA-HSA polypeptides were visualized by detection with 1-step TMB (34028, Thermo), quenching with 2N sulfuric acid prior to reading the absorbance at 450 nm.

Quantification of the modified u-PA and modified u-PA-HSA polypeptides in VH by activity was followed using an assay based on the hydrolysis of a quenched-fluorescence peptide substrate (FRET) and calibrated to a standard curve of modified u-PA polypeptides of known active concentration. This assay uses a FRET peptide substrate based on the cleavage sequence of human complement 3 (C3). The sequence of the peptide is RQHAR/ASHL, where the "/" indicates the cleavage site. The N-terminal side of the peptide is labeled with a DABCYL fluorophore, and the C-terminal side is labeled with an EDANS fluorophore. Cleavage of the peptide separates the EDANS/DABCYL FRET pair to generate a fluorescent signal, which is measured in a multi-well fluorescence plate reader.

The assay was conducted as follows: test samples are typically diluted to a minimum required dilution of 1:20 in assay buffer (100 mM Tris, 50 mM NaCl, 0.01% Tween-80, pH 7.4). The diluted samples are further diluted 1:2 with 80 μM FRET substrate in a 96-well plate. Immediately upon the combination of diluted test samples and substrate, the fluorescence signal following FRET substrate hydrolysis was evaluated in a fluorescence plate reader with measurements every 30 seconds for 2 hours. Enzymatic hydrolysis of the FRET peptide substrate generates an EDANS fluorescent product. The rate of generation of fluorescence intensity is interpolated against an EDANS standard curve to yield the EDANS product generation rate. The specific activity may be calculated in two ways. First, the product generation rate is multiplied by the dilution factor to yield a volumetric specific activity in units of nmol product per minute of reaction per mL of sample (nmol/min/mL). The volumetric specific activity indicates the total amount of active enzyme in the sample. Secondly, the specific activity is calculated by dividing the volumetric specific activity by the sample enzyme concentration to yield an enzyme specific activity in units of nmol product per minute of reaction per mg of enzyme (nmol/min/mg). For testing to determine the apparent protease concentration of unknown samples (e.g., in vivo PK samples), the volumetric specific activity of the sample (nmol/min/mL) is divided by the enzyme specific activity of the control modified u-PA or modified u-PA-HSA polypeptide (nmol/min/mg) to yield the apparent protease concentration in the sample (mg/mL).

Data for each eye and animal are provided in the Table below. The concentrations obtained for each eye were averaged per animal. Then the drug concentrations for each animal was averaged at each time point to compensate for the inter-animal variability. The means at each time point were computed and presented in the Table below. The resulting data then were subjected to the following analytical methodology: First, a semi-parametric piecewise robust regression approach developed by Lee et al., (see, Lee et al., (1990) *J. Lab Clin. Med.* 115:745-748; and Lee et al. (1997) "The use of robust regression techniques to obtain improved coagulation factor half-life estimates. XVIth Congress of the International Society for Thrombosis and Hemostasis," Florence, Italy) was used for computing the half-life. It is a compartmental model. The data were evaluated using the program Demitasse, which has been validated and used for FDA submissions. For analyses of area under the time curve (AUC) and the other PK parameters, a non-compartmental model based on the trapezoidal rule was used. The PK parameters were calculated and are set forth in the tables below.

TABLE

| Condition | time point (d) | Drug Concentration by ELISA (nM) | Drug Concentration by Activity (nM) |
|---|---|---|---|
| Modified u-PA-HSAi | 0 | 842.90 | n.d. |
| | 1 | 385.08 | n.d. |
| | 1 | 122.79 | n.d. |
| | 1 | 289.90 | n.d. |
| | 1 | 270.36 | n.d. |

TABLE-continued

| Condition | time point (d) | Drug Concentration by ELISA (nM) | Drug Concentration by Activity (nM) |
|---|---|---|---|
| | 3 | 289.25 | n.d. |
| | 3 | 257.84 | n.d. |
| | 3 | 254.54 | n.d. |
| | 3 | 265.59 | n.d. |
| | 7 | 120.94 | n.d. |
| | 7 | 138.35 | n.d. |
| | 7 | 144.15 | n.d. |
| | 7 | 113.22 | n.d. |
| | 14 | 30.13 | n.d. |
| | 14 | 27.53 | n.d. |
| | 14 | 36.28 | n.d. |
| | 14 | 25.37 | n.d. |
| Modified u-PA-HSAa | 0 | 842.90 | 842.90 |
| | 1 | 368.35 | 749.14 |
| | 1 | 264.23 | 344.78 |
| | 1 | 311.69 | 460.72 |
| | 1 | <LOD | 0.35 |
| | 3 | 199.27 | 505.84 |
| | 3 | 168.21 | 283.60 |
| | 3 | 132.80 | 179.47 |
| | 3 | 181.28 | 239.77 |
| | 7 | 64.47 | 156.92 |
| | 7 | 61.08 | 82.45 |
| | 7 | 73.70 | 98.58 |
| | 7 | 51.94 | 51.25 |
| | 14 | 9.69 | 31.96 |
| | 14 | 7.55 | 72.49 |
| | 14 | 5.35 | 15.63 |
| | 14 | 6.79 | 10.38 |
| Modified u-PA (SEQ ID NO. 21) | 0 | 1838.69 | 1838.69 |
| | 1 | 214.47 | 203.44 |
| | 1 | 222.15 | 251.46 |
| | 1 | 182.63 | 183.70 |
| | 3 | <LOD | 6.48 |
| | 3 | 130.01 | 110.85 |
| | 3 | 98.91 | 75.91 |
| | 7 | 21.55 | 25.24 |
| | 7 | 31.49 | 19.44 |

*Cells in bold were outside limits of detection and/or considered outliers or excluded based on an outlier test

TABLE

| Study day | Modified u-PA-HSAi (ELISA) | Modified u-PA-HSAa (ELISA) | Modified u-PA (ELISA) |
|---|---|---|---|
| 1 | 267.03 | 314.76 | 206.42 |
| 3 | 266.81 | 170.39 | 114.46 |
| 7 | 129.16 | 62.80 | 26.52 |
| 14 | 29.83 | 7.35 | n/a |

| Study day | Modified u-PA-HSAi (Activity) | Modified u-PA-HSAa (Activity) | Modified u-PA (Activity) |
|---|---|---|---|
| 1 | n.d. | 388.75 | 212.86 |
| 3 | n.d. | 302.17 | 64.41 |
| 7 | n.d. | 97.30 | 22.34 |
| 14 | n.d. | 32.61 | n/a |

| Test article | ELISA Results (t-half terminal-days) | Activity Results (t-half terminal-days) |
|---|---|---|
| Modified u-PA-HSAi | 3.42 (MRT = 5.56) | n.d. |
| Modified u-PA-HSAa | 2.42 (MRT = 3.79) | 3.27 (MRT = 4.71) |
| Modified u-PA (SEQ ID NO: 21) | 2.01 (MRT = 3.29) | 1.95 (MRT = 3.01) |

Based on ELISA and activity assays, the modified protease domain of u-PA (containing the modified u-PA polypeptide of SEQ ID NO:21) has a half-life of approximately 2 days. Fusion to HSA, increases the half-life of the protein. The activated modified u-PA-HSAa had a half-life of 2.42 days and 3.27 days, as measured by ELISA and activity, respectively. Half-life was increased for u-PA-HSA subjected to the inhibition protocol with an ELISA-determined half-life of 3.42 days. Thus, fusion of u-PA to HSA increases the protein half-life in vivo, and the fusion protein retains protease activity in vivo.

Example 16

Cloning, Expression and Preparation of u-PA Fusion Proteins

A. Cloning of u-PA Fusion Polypeptides u-PA fusion proteins were generated with fusion partners at either the N-terminus or C-terminus.

1. Exemplary Fusion Proteins

Several alternate constructs for expression of u-PA fusion proteins were generated (described below). For example, N-terminal fusion proteins were generated (see, e.g., FIG. 2A). The constructs contained (from N-terminal to C-terminal): (1) a secretion signal (e.g., mouse Ig kappa chain V-III region (IgGκ) (SEQ ID NO: 999)); (2) a fusion partner (e.g., IgG1 Fc (SEQ ID NO: 992)); (3) linker, such as AGS (SEQ ID NO: 1003); to the (4) wild-type u-PA activation sequence (SEQ ID NO: 997; amino acids 167-178 of SEQ ID NO: 1); and (5) the modified u-PA protease domain (SEQ ID NO: 987). An example of an N-terminal fusion protein is set forth in SEQ ID NO: 1004.

Figure 3A:
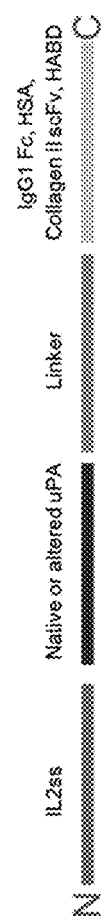
FIGS. 3A-3C are schematics of C-terminal u-PA fusion proteins.
Figure 3B:
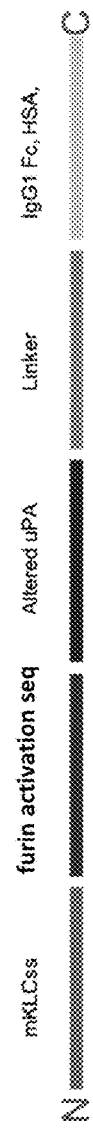
Figure 3C:

C-terminal fusion proteins also were generated (see, e.g., FIG. 3). In some examples the constructs contained (from N-terminal to C-terminal): (1) a secretion signal (mouse Ig kappa chain V-III region (IgGκ) (SEQ ID NO: 999); or human Interleukin-2 (hIL2) (SEQ ID NO: 1000)); (2) the wild-type u-PA activation sequence (SEQ ID NO: 997 or 998), furin activation sequence (SEQ ID NO: 995, 996, or 1041), or no activation sequence; (3) the modified u-PA protease domain (SEQ ID NO: 987 or 21) or the wild-type u-PA protease domain (SEQ ID NO: 2 or 5); (4) a linker (SEQ ID NO: 1002 or 1003); and (5) a fusion partner (i.e., IgG1 Fc (SEQ ID NO: 992); human serum albumin (HSA) (SEQ ID NO: 991); scFv that binds to Collagen IIm (C2scFv) (SEQ ID NO: 993); or an Hyaluronic acid binding domain (HABD)(SEQ ID NO: 994)). Examples of C-terminal fusion proteins are set forth in SEQ ID NOs: 1006-1010, 1012, 1013, 1016, and 1040 (see e.g., FIGS. 3A and 3B).

C-terminal fusion proteins containing the u-PA N-terminal region also were generated. The constructs contained (from N-terminal to C-terminal): (1) a secretion signal (mouse Ig kappa chain V-III region (IgGκ); SEQ ID NO: 999); (2) the wild-type u-PA N-terminal region (amino acids 21-178 of SEQ ID NO: 1 or SEQ ID NO: 1042); (3) an activation sequence of u-PA (SEQ ID NO: 997 or 998) or a furin activation sequence (SEQ ID NO: 995, 996, or 1041); (4) the modified u-PA catalytic domain (SEQ ID NO: 987 or SEQ ID NO:5, except with C122, by chymotrypsin numbering, or SEQ ID NO: 21); (5) a linker (SEQ ID NO: 1002 or 1003); and (6) a fusion partner (i.e., IgG1 Fc (SEQ ID NO: 992); human serum albumin (HSA) (SEQ ID NO: 991)). Examples of C-terminal fusion proteins are set forth in SEQ ID NOs: 1011, 1014, 1015 and 1036 (see e.g., FIG. 3C). See, also SEQ ID NO:1010, which contains a furin activation sequence in place of the u-PA Fusion proteins containing SUMO at the N-terminus and the fusion partner at the C-terminus also were generated. The constructs contained (from N-terminal to C-terminal): (1) a secretion signal (mouse Ig kappa chain V-III region (IgGκ) (SEQ ID NO: 999)); (2) a HIS linker and SUMO sequence (SEQ ID NO: 990); (3) the modified u-PA catalytic domain (SEQ ID NO: 987); (4) a linker (SEQ ID NO: 1002); and (5) a fusion partner (i.e., IgG1 Fc (SEQ ID NO: 992); or human serum albumin (HSA) (SEQ ID NO: 991)). Examples of C-terminal fusion proteins are set forth in SEQ ID NOs: 1016 and 1017.

Figure 2A:
FIGS. 2A-2B are schematics of N-terminal u-PA fusion proteins.
Figure 2B:

A full-length u-PA protein that was not fused to a fusion partner was generated as a control (see, e.g., FIG. 2B). The construct contained (from N-terminal to C-terminal): (1) secretion signal (mouse Ig kappa chain V-II region (IgGκ) (SEQ TD NO: 999)); (2) the N-terminal domain of A-PA (SEQ ID NO:1040; amino acids 21-166 of SEQ TD NO: 1); (3) a u-PA activation sequence (SEQ ID NO: 997); and (4) the modified u-PA protease domain (SEQ ID NO: 987). An example of a full-length u-PA protein is set forth in SEQ TD NO: 1005. The following is a summary of the constructs that were generated:

set forth in SEQ ID NO: 1015 contains a wild type u-PA activation sequence for activation; and the fusion protein set forth in SEQ ID NO: 1016 contains a furin domain for activation. The fusion proteins set forth in SEQ ID NOs: 1017 and 1018 contain SUMO as an activation domain at the N-terminus, and HSA or IgG-Fc at the C-terminus, respectively. Furin activation sequences were added to the fusion proteins set forth in SEQ ID NOs: 1010, 1014 and 1016 so that the protein can be activated during expression, thereby eliminating a requirement for an activation step during downstream processing.

2. Construct Generation (a) Preparation of u-PA Constructs

The constructs were assembled from synthetic oligonucleotides and/or PCR products and cloned into the

| SEQ ID NO: | Signal Sequence | Fusion partner | Activation Sequence | Fusion partner location | Protease domain of u-PA |
|---|---|---|---|---|---|
| 1004 | IgGκ | IgG1 Fc | u-PA with Cys | N-terminus | SEQ ID NO: 987 |
| 1005 | IgGκ | No fusion partner | Full-length uPA w/ Cys | No fusion partner | SEQ ID NO: 987 |
| 1006 | hIL2 | IgG1 Fc | No Activation Sequence | C-terminus | SEQ ID NO: 21 |
| 1007 | hIL2 | HSA | No Activation Sequence | C-terminus | SEQ ID NO: 21 |
| 1008 | hIL2 | C2 scFv | No Activation Sequence | C-terminus | SEQ ID NO: 21 |
| 1009 | hIL2 | HABD | No Activation Sequence | C-terminus | SEQ ID NO: 21 |
| 1010 | IgGκ | IgG1Fc | u-PA furin w/o Cys | C-terminus | SEQ ID NO: 21 |
| 1011 | IgGκ | IgG1Fc | Full-length wild type uPA w/ Cys | C-terminus | SEQ ID NO: 987 |
| 1012 | hIL2 | IgG1 Fc | No Activation Sequence | C-terminus | SEQ ID NO: 5 |
| 1013 | hIL2 | HSA | No Activation Sequence | C-terminus | SEQ ID NO: 5 |
| 1014 | IgGκ | HSA | furin with Cys | C-terminus | SEQ ID NO: 987 |
| 1015 | IgGκ | HSA | u-PA with Cys | C-terminus | SEQ ID NO: 987 |
| 1016 | IgGκ | HSA | furin without Cys | C-terminus | SEQ ID NO: 21 |
| 1017 | IgGκ | HSA | SUMO | C-terminus | SEQ ID NO: 21 |
| 1018 | IgGκ | IgG1 Fc | SUMO | C-terminus | SEQ ID NO: 21 |

The control protein has the sequence set forth in SEQ TD NO: 1005. The control protein contains the u-PA N-terminus (residues 1-158 of SEQ ID NO: 3), wild-type u-PA activation sequence, and u-PA protease domain (SEQ ID NO:987), and no fusion partner. The fusion protein set forth in SEQ TD NO: 1004 includes the fusion partner (Fc) at the N-terminus. The fusion proteins set forth in SEQ ID NOs: 1006-1009 have different fusion partners at the C-terminus and lack an activation sequence N-terminal to the modified u-PA protease domain. The fusion proteins set forth in SEQ ID NOs: 1010 and 1011 contain Fc at the C-terminus and are activated differently from each other: the fusion protein set forth in SEQ ID NO: 1010 contains a furin activation sequence; and the fusion protein set forth in SEQ ID NO: 1011 contains the n-terminal region of u-PA and a wild-type u-PA activation sequence. The fusion proteins set forth in SEQ ID NOs: 1012 and 1013 are the same as the fusion proteins set forth in SEQ ID NOs: 1006 and 1007, respectively, but have the wild-type u-PA protease domain in place of the modified u-PA protease domain.

The fusion proteins set forth in SEQ ID NOs: 1014-1016 contain HSA at the C-terminus and are activated differently from each other: the fusion protein set forth in SEQ ID NO: 1014 contains a furin activation sequence; the fusion protein pcDNA3.4-TOPO vector (Invitrogen; Cat. No. A14697) for expression under control of the human cytomegalovirus (CMV) immediate-early promoter/enhancer.

(b) Preparation of SUMO-u-PA Constructs

For expression of fusion proteins containing a SUMO tag (set forth in SEQ ID NOs: 1017 and 1018), DNA encoding the modified u-PA polypeptide with C122S (set forth in SEQ ID NO: 21) was cloned into the codon optimized pE5 expression vector (Thermo Scientific; sequence set forth in SEQ ID NO:988). The pE5 plasmid contains a multiple cloning site C-terminal to a SUMO sequence for cloning the fusion partner (HSA or $F_c$) and the modified u-PA protease domain. The final fusion protein is (1) a fusion partner (HSA or FC); (2) the modified u-PA protease domain with C122S (SEQ ID NO: 21); with an (3) N-terminal 6×His purification tag; and (4) SUMO.

B. Preparation of u-PA Fusion Polypeptides

Expected molecular weights of the u-PA fusion proteins are set forth below:

| Name | Expected MW Non-Reduced | Expected MW Reduced MW with activation | MW without activation |
|---|---|---|---|
| 1004 | 111,012 | Modified u-PA: 28,445.36 Fc: 27,078.73 | 55506.07 |
| 1005 | 46,389 | Modified u-PA: 28,445.36 uPA: 17,961.36 | 46388.7 |
| 1006 | 108,467 | 54233.44 | |
| 1007 | 95,286 | 95285.85 | |
| 1008 | 55,226 | 55226 | |
| 1009 | 40,297 | 40297 | |
| 1010 | 111,146 | 54233.44 | 55573 |
| 1011 | 144,386 | uPA: 17,961.36 Modified u-PA-Fc: 54,249.50 | 72192.85 |
| 1012 | 108,461 | 54230.5 | |
| 1013 | 95,283 | 95282.91 | |

1. Transformation, Expression, Folding and Refolding of u-PA Fusion Proteins

Fusion proteins with the sequences set forth in SEQ ID NOs: 1004-1013 were transformed and expressed as detailed in Example 14, above.

2. Transformation, Expression, Folding and Refolding of u-PA-SUMO (Small Ubiquitin-Like Modifier) Fusion Proteins Fusion proteins with the sequences set forth in SEQ ID NOs: 1017 and 1018 were prepared as detailed below.

Cloning of the SUMO-Modified u-PA Fusion Polypeptide for *E. coli* Expression

Competent BL21 Gold (DE3) *E. coli* cells are transformed with u-PA fusion protein in an expression vector (SEQ ID NO: 988), which was prepared by Thermo Scientific, using the standard heat shock method. The plasmid DNA is resuspended in 50 μL MQ water to obtain a 100 ng/mL stock solution. The plasmid DNA and competent BL21 Gold DE3 cells are thawed on ice. 0.5 μL DNA, are added to 50 μL cells in a sterile microfuge tube and incubated on ice for 30 minutes. The cell/DNA mixture are heat shocked by placing at 42° C. for 45 seconds. The cell/DNA mixture immediately are transferred back to ice and incubated on ice for 2 minutes. 450 μL pre-warmed (37° C.) SOC media is added to the cell/DNA mixture, and the resulting SOC/cell/DNA mixture is incubated at 37° C. with shaking. The cells in SOC (2-200 μL) are plated and spread on LB-carbenicillin plates, which are incubated overnight at 37° C. The plates harboring bacterial colonies are removed from the incubator, sealed with parafilm and stored at 4° C. Glycerol stocks of individual transformed colonies are prepared by standard methods and stored at −70° C.

C. Assessing Protein Expression of Fusion Proteins in Mammalian Cell Culture

Protein concentration from the expi293 cell culture supernatant (see Example 14) was assessed by ELISA and qualitatively by western blot. Protein expression after western blotting was scored on a 1 to 5 scale where 1 represents the highest expression and 5 represents no expression.

Six samples were tested for each construct. The results are set forth in the tables below. The results show that by ELISA and Western Blotting of the fusion proteins set forth in SEQ ID NOs: 1004, 1007-1009 and 1013 were poorly expressed. The proteins set forth in SEQ ID NOs: 1005, 1010 and 1011 had the highest expression as assessed by qualitative western blot and ELISA.

TABLE

Protein Expression Assessed by ELISA

| Sample SEQ ID | ELISA Titer (mg/L) | u-PA ELISA (mg/L) |
|---|---|---|
| 1004 | 0.4 | 0.4 |
| 1005 | 75.39 | 149.7 |
| 1006 | 2.2 | 2.6 |
| 1007 | 0.3 | 0.3 |
| 1008 | 0.06 | 0.1 |
| 1009 | 0.26 | 0.3 |
| 1010 | 15.89 | 17.3 |
| 1011 | 21.66 | 19.3 |
| 1012 | 7.5 | 16.2 |
| 1013 | 5.46 | 4.7 |

R squared = 0.9993; limit of detection = 0.109 ng/mL; limit of quantitation = 1.375 ng/mL

TABLE

Protein Expression Assessed by Western Blotting

| SEQ ID NO: | SDS-PAGE/Western Ranking |
|---|---|
| 1004 | 4 |
| 1005 | 1 |
| 1006 | 3 |
| 1007 | 3 |
| 1008 | 5 |
| 1009 | 5 |
| 1010 | 1 |
| 1011 | 1 |
| 1012 | 3 |
| 1013 | 4 |

D. Fusion Protein Activation Strategies

Various strategies were employed for u-PA activation. The proteins set forth in SEQ ID NOs: 1004-1005, 1011 and 1015 were activated by plasmin, as detailed above in Example 14. The proteins set forth in SEQ ID NOs: 1010, 1014 and 1016 were expected to be activated by intracellular furin during expression. The protein set forth in SEQ ID NO: 1006-1008 were anticipated to be auto-activated during expression. The proteins set forth in SEQ ID NOs: 1017 and 1018 were activated by SUMO protease treatment. To activate the SUMO-u-PA constructs, typically 10 Units of SUMO protease per 1 mg of protein was added and allowed to incubate overnight at 4° C. Further purification on a HisTrap nickel chelation column would effectively remove the His-tagged SUMO moiety.

| SEQ ID NO: | Activation Sequence | Activation Strategy |
|---|---|---|
| 1004 | uPA wt w/ Cys | Plasmin treatment |
| 1005 | Full-length uPA w/ Cys | Plasmin treatment |
| 1006 | No activation sequence | Secretion signal cleavage during expression generates activated protease |
| 1007 | No activation sequence | Secretion signal cleavage during expression generates activated protease |
| 1008 | No activation sequence | Secretion signal cleavage during expression generates activated protease |
| 1009 | C3 activation sequence | C3 sequence autoactivated post expression |
| 1010 | uPA Furin w/o Cys | Furin activation during expression; activiation not necessary during downstream processing |

-continued

| SEQ ID NO: | Activation Sequence | Activation Strategy |
|---|---|---|
| 1011 | Full-length WT uPA w/ Cys | Plasmin treatment |
| 1012 | No activation sequence | Secretion signal cleavage during expression generates activated protease |
| 1013 | No activation sequence | Secretion signal cleavage during expression generates activated protease |
| 1014 | Furin with Cys | Intracellular activation by Furin during expression; activation not necessary during downstream processing |
| 1015 | uPA with Cys | Plasmin treatment |
| 1016 | Furin without Cys | Intracellular activation by Furin during expression; activation not necessary during downstream processing |
| 1017 | SUMO | SUMO protease treatment |
| 1018 | SUMO | SUMO protease treatment |

E. Measuring Enzyme Activity

Volume specific activity of expi293 HEK supernatants containing the u-PA fusion proteins on 40 µM human C3 FRET peptide was assessed as described in Example 15. The interpolated, dilution-adjusted initial rate (nM EDANS/min/µL sample) was calculated. Fusion proteins set forth in SEQ ID NOs: 1004, 1005, 1008 and 1011-1013 showed no activity. Fusion proteins set forth in SEQ ID NOs: 1006, 1007, 1009 and 1010 demonstrated u-PA protease activity. Modified u-PA with a Furin activation sequence N-terminal to u-PA with an Ig FC fusion at the C-terminus (set forth in SEQ ID NO: 1010) showed the highest activity. The results are set forth in the table below.

| SEQ ID NO. | Activity (nM EDANS/min/µL sample) | Can auto-activate | No Activity on Mouse C3 |
|---|---|---|---|
| 1004 | −0.1 | | |
| 1005 | −0.1 | | |
| 1006 | 3.7 | X | X |
| 1007 | 3.2 | X | X |
| 1008 | 0.3 | X | |
| 1009 | 2.7 | X | |
| 1010 | 56.0 | X | |
| 1011 | −0.1 | | |
| 1012 | 0.0 | X | |
| 1013 | 0.1 | X | |

F. Affinity Purification

The fusion proteins set forth in SEQ ID NOs: 1010 and 1011 had the greatest expression as assessed by western blotting and ELISA. The Furin-variant u-PA-Fc and full-length uPA-Fc fusion proteins set forth in SEQ ID NOs: 1010 and 1011, respectively, were Protein A affinity purified using the manufacturer's recommended conditions (GE Healthcare).

G. Purification and Activity Assessment of High-Expressing Fusion Proteins

After affinity purification, protein concentrations were assessed by absorbance at 280 nm and by the u-PA ELISA (see Example 15), while purity was evaluated by SDS-PAGE gel electrophoresis and analytical size exclusion chromatography (SEC), as described above in Example 14. Both fusion proteins were expressed. Purity, when assessed by gel electrophoresis and staining, and by analytical size exclusion chromatography (SEC), was deemed to be poor for the fusion protein whose sequence is set forth in SEQ ID NO: 1010 (u-PA Furin w/o Cys). Purity by gel electrophoresis was deemed good for the fusion protein set forth in SEQ ID NO: 1011 (full-length WT uPA w/Cys). The results are set forth in the table below:

| SEQ ID NO. | Column | Total Volume (mL) | Concentration (mg/mL) A280 | Concentration (mg/mL) ELISA | Total Protein Yield (mg) A280 | Total Protein Yield (mg) ELISA | Purity by Gel | Purity by SEC |
|---|---|---|---|---|---|---|---|---|
| 1010 | ProA | 8.6 | 4.23 | 0.60 | 36.38 | 5.19 | Poor | Poor |
| 1011 | ProA | 13.6 | 1.69 | 1.04 | 22.98 | 14.09 | Good | Poor | u-PA enzyme activity after affinity purification was assessed on the Human C3 FRET Peptide assay as described above in Example 15. The results are set forth in the table below:

| SEQ ID NO. | Volumetric Specific Activity (nmol/min/mL) | A280: Enzyme Specific Activity (nmol/min/mg) | A280: Relative Activity to the u-PA SEQ ID NO: 21 | ELISA: Enzyme Specific Activity (nmol/min/mg) | ELISA: Activity Relative to variant u-PA protease domain (SEQ ID NO 21) |
|---|---|---|---|---|---|
| 1010 | 466.81 | 110.36 | 2% | 773.05 | 45% |
| 1011 | 0.10 | 0.06 | 0% | 0.10 | 0% |

The u-PA enzyme activity after affinity purification was assessed on the Human C3 FRET Peptide assay as described above in Example 15. Enzyme activity was assessed after plasmin activation as described above in Example 14. The results are set forth in the table below:

| SEQ ID NO. | Enzyme specific activity (nmol/min/mg) | Relative activity (nmol/min/mg) to u-PA SEQ ID NO: 21 | MW | Enzyme specific activity (nmol/min/nmol) | Relative activity (nmol/min/nmol) compared to u-PA SEQ ID NO: 21 |
|---|---|---|---|---|---|
| 21 | 692 | 100% | 28429 | 19.7 | 100% |
| 1011 | 198 | 29% | 144385 | 14.3 | 73% |
| 1015 | 178 | 26% | 95301 | 20.2 | 103% |

H. Description of Fusion Proteins with Modified u-PA Polypeptides that Cleave C3

Fusion proteins with u-PA polypeptides are described below. Exemplary sequences are provided in the following discussion.

1. Catalytic Domains

The catalytic domain (protease domain) can be any of the protease domains of the modified u-PA polypeptides provided herein (see Example 2, Table 14, which provides the $ED_{50}$ for protease domains containing various modifications as described herein and in the Examples), particularly any with an ED$_{50}$ less than 100 nM, as described in Example 2, or less than 50 nM, 30 nM, or 10 nM. Exemplary of the modified uPA protease domain is that set forth in SEQ ID NO:21, except, when using it to activate to produce a two chain polypeptide, residue 122 (by chymotrypsin numbering) is C, not S as in SEQ ID NO:21. Tab The modified uPA polypeptide protease domains:

```
SEQ ID NO: 987:
IIGGEFTTIENQPWFAAIYQRYEGGSEYYR

CGGSLISPCWVISATHCFIPQPKKEDYIVYLGRSRLNSNT

QGEMKFEVENLILHKDYSADIAAQHNDIALLKIRSKEGRC

AQPSRTIQTICLPSMYNDPQFGTSCEITGFGKENSTDRLY

PEQLKMTVVKLISHRECQQPHYYGSEVTTKMLCAADPQWK

TDSCQGDSGGPLVCSLQGRMLTGIVSWGRGCALKDKPGV

YTRVSHFLPWIRSHTKEENGLAL;
```

SEQ ID NO: 21 modified uPA polypeptide protease domain containing a C122S mutation: IIGGEFTTIENQPW-FAAIYQRYEGGSEYYRCG GSLISPCWVI SATHCFIPQPKKEDYIVYLGRSRLNSNTQGEMKFE-VENLI LHKDYSADIA AQHNDIALLKIRSKEGR-CAQPSRTIQTISLPSMYNDPQFGTSCEITGFGKENST DRLYPEQLKMTVVKLISHRECQQPHYYG-SEVTTKMLCAADPQWKTDSCQGD SGG-PLVCSLQGRMTLT-GIVSWGRGCALKDKPGVYTRVSHFLPWIRSHTKEEN GLAL contain amino acid replacements compared to the native uPA polypeptide protease domain SEQ ID NO: 2:

```
IIGGEFTTIE NQPWFAAIYRRHRGGSVTYVCGGSL[I/M]SPCWVISATH

CFIDYPKKEDYIVYLGRSRLNSNTQGEMKFEVENLILHKDYSADTLAHHN

DIALLKIRSKEGRCAQPSRTIQTICLPSMYNDPQFGTSCEITGFGKENST

DYLYPEQLKMTVVKLISHRECQQPHYYGSEVTTKMLCAADPQWKTDSCQG

DSGGPLVCSLQGRMLTGIVSWGRGCALKDKPGVYTRVSHFLPW IRSHTK

EENG LAL;
``` or compared to the protease domain in which the C at residue 122 (by chymotrypsin numbering) is S as set forth in SEQ ID NO:5:

```
IIGGEFTTIENQPWFAAIYRRHRGGSVTYVCGGSLISPCWVISAT

HCFIDYPKKEDYIVYLGRSRLNSNTQGEMKFEVENLILHKDYSAD

TLAHHNDIALLKIRSKEGRCAQPSRTIQTISLPSMYNDPQFGTSC

EITGFGKENSTDYLYPEQLKMTVVKLISHRECQQPHYYGSEVTTK
```

```
MLCAADPQWKTDSCQGDSGGPLVCSLQGRMTLTGIVSWGRGCALK

DKPGVYTRVSHFLPWIRSHTKEENGLAL.
```

As shown herein, the modified u-PA polypeptides, exhibit altered proteolytic activity and biochemical properties compared to the native u-PA. The u-PA polypeptides are modified to have increased activity for cleaving C3, as described herein, and to have reduced activity for cleaving their native substrate.

2. Secretion Signals

To ensure the extracellular secretion of modified u-PA polypeptide during protein expression, a secretion signal can be included in the construct to direct secretion of the encoded polypeptide upon expression. Many such signals are known to those of skill in the art. These include the native u-PA signal, and others, such as the mKLC secretion signal (SEQ ID NO: 999 (METDTLLLWVLLLWVPGSTG)) sequence or the human IL2 secretion signal (SEQ ID NO: 1000 (MYRMQLLSCI ALSLALVTNS), and others exemplified herein. Signal sequences generally occur on the N-terminus of a polypeptide to direct secretion; they are removed by the host cell.

3. Fusion Partners

In addition to amino acid replacement, insertion or deletion, additional modifications can be added to the uPA polypeptide to create a fusion or chimeric protein. Numerous fusion partners and their properties are known to those of skill in the art. These include, for example, fusion partners that can multimerized, those that can increase serum half-life, and those that alter binding properties or target the polypeptide. For example, modified and native uPA polypeptides can be linked to an antibody fragment or multimerization domain such as the Fc region of an immunoglobulin polypeptide IgG1 (SEQ ID NO:992 (DKTHTCPPCPAPELLGGPS VFLFPPKPKDTLMISRTPEVTCVVVDVSHEDPEVKFNWYVDGVEVHNAKTKP REEQYNSTYRVVSVLTVLHQDWLNGKEYKCKVSNKALPAPIEKTISKAKGQP REPQVYTLPPSRDELTKNQVSLTCLVKGFYPSDIAVEWESNGQPENNYKTTPP VLDSDGSFFLYSKLTVDKSRWQQGNVFSCSVMHEALHNHYTQKSLSLSPG)) or Collagen II scFv (SEQ ID NO: 993 (QVQLQQPGADLVRPGVSVKLSCKAS GYTFTSYWMNWVKQRPGQGLEWIGMIHPSDSETRLSQKFKDKATLTVDKSS STAYMQLSSPTSEDSAVYYCARLKPGGTWFAYWGQGTLVTVSAGGGGSGG GGSGGGGSGGSDIVLTQSPASLTVSLGQRATISCRASKSVDSYGNSFMEWYQ QKPGQPPKLLIYRASNLESGIPARFSGSGSRTD FTLTINPVEA DDVATYYCQQ SNEDPYTFGGGTKLEIK)) to alter pharmacological properties of the u-PA polypeptides.

To alter pharmacological properties, the uPA polypeptides, for example, can be fused to a ligand or polypeptide, such as an antibody, or other protein, such as human serum albumin (HSA; SEQ ID NO: 991):

```
DAHKSEVAHRFKDLGEENFKALVLIAFAQYLQQCPFEDHVKLVNEVTEFAKT
CVADESAENCDKSLHTLFGDKLCTVATLRETYGEMADCCAKQEPERNECFL
QHKDDNPNLPRLVRPEVDVMCTAFHDNEETFLKKYLYEIARRHPYFYAPELL
FFAKRYKAAFTECCQAADKAACLLPKLDELRDEGKASSAKQRLKCASLQKF
GERAFKAWAVARLSQRFPKAEFAEVSKLVTDLTKVHTECCHGDLLECADDR
ADLAKYICENQDSISSKLKECCEKPLLEKSHCIAEVENDEMPADLPSLAADFV
ESKDVCKNYAEAKDVFLGMFLYEYARRHPDYSVVLLLRLAKTYETTLEKCC
AAADPHECYAKVFDEFKPLVEEPQNLIKQNCELFEQLGEYKFQNALLVRYTK
```

-continued

```
KVPQVSTPTLVEVSRNLGKVGSKCCKHPEAKRMPCAEDYLSVVLNQLCVLH
EKTPVSDRVTKCCTESLVNRRPCFSALEVDETYVPKEFNAETFTFHADICTLSE
KERQIKKQTALVELVKHKPKATKEQLKAVMDDFAAFVEKCCKADDKETCFA
EEGKKLVAASQAALGL), or a hyaluronic acid binding domain (HABD), such as
TSG-6 (SEQ ID NO: 994) ERAAGVYHREA RSGKYKLTYAEAKAVCEFEGG
HLATYKQLEAARKIGFHVCAAGWMAKGRVGYPIVKPGPNCGFGKTGIIDYGI
RLNRSER WDAYCYNPHAKE.
```

Typically, the u-PA protease activity remains functionally active within the resulting fusion protein, but the fusion peptide may change the pharmacokinetic and pharmacodynamic parameters of the u-PA polypeptide. Other fusion proteins containing a u-PA modified polypeptide can be created with a growth factor or a receptor to alter pharmacokinetic and pharmacodynamic properties.

4. Activation Sequences

The u-PA polypeptide can be produced in an inactive form (zymogen) and modified posttranslationally via proteolytic cleavage to generate a mature and activated form. To do so, an activation sequence is included on the native or modified u-PA polypeptide to suppress its enzymatic activity. After protein expression, cleavage of the activation sequence produces a mature u-PA protein. Examples of activations sequences, include, but are not limited to, the wild-type u-PA activation sequence (SEQ ID NO: 997 (QCGQKTLRPRFK) or SEQ ID NO: 998 (QSGQKTLRPRFK)) or a furin cleavage sequence (SEQ ID NOS: 995, 996, 1041, or 1044 (such as QCGQKTLRRRKR, or QSGQKTLRRRKR, or QSG KTLRRKR, or QSGQKTLRRKR)). A disulfide linkage can be maintained between the cysteine within the activation sequence and the cysteine (C122 by chymotrypsin numbering) within the u-PA catalytic domain. Upon cleavage of the activation sequence, the activated molecule retains a covalent linkage between the N-terminal fragment activation or full N-terminal domain.

5. Linkers

To join the u-PA polypeptide with other polypeptide sequences, a short, flexible sequence of amino acids (linker) is used. Examples of linkers include but are not limited to GGSSGG or GGGGS or AGS (such as those set forth in SEQ ID NOS: 1001-1003 and 1024-1030), as well as those discussed in the detailed description. Longer linkages with concatenations of these sequences repeated also are included such that a linker has the sequence $(GGSSGG)_{n+1}$, where n is 0 or an integer between 1 and 20. Other linkers are set forth in the Sequence Listing and in the Detailed Description.

6. Other Modification of u-PA

Other peptide sequences such as 6×His SUMO (such as those set forth in SEQ ID NOS: 990, and 1031-1033 (DGHHHHHHGS LQDSEVNQEA KPEVKPEVKP ETHINLKVSD GSSEIFFKIK KTTPLRRLME AFAKRQGKEM DSL(T/R) FLYDGI (E/R) IQADQ (T/A) PED LDMEDNDIIE AHREQIGG)) can be added to facilitate the expression, secretion or purification of u-PA polypeptides. Additional chemical and posttranslational modification to the altered or native u-PA polypeptide can include but are not limited to a conjugation to a polymer such as PEGylation, PASylation, and sialylation to alter pharmacodynamic properties of the u-PA polypeptide.

7. Exemplary Modified u-PA Polypeptides with N-Terminal Fusions

| Seq ID No. | Name | Sequence signal (residue nos.) | Fusion partner (residue nos.) | Linker (residue nos.) | Activation Sequence (residue nos.) | Catalytic domain (residue nos.) | Other N terminal domain (residue nos.) |
|---|---|---|---|---|---|---|---|
| 1004 | Fc-u-PA (SEQ ID NO: 987) | METDTLLL WVLLLWVP GSTG (1-20) | DKTHTCPPCP APELLGGPSV FLFPPKPKDT LMISRTPEVT CVVVDVSHED PEVKFNWYVD GVEVHNAKTK PREEQYNSTY RVVSVLTVLH QDWLNGKEYK CKVSNKALPA PIEKTISKAK GQPREPQVYT LPPSRDELTK NQVSLTCLVK GFYPSDIAVE WESNGQPENN YKTTPPVLDS DGSFFLYSKL TVDKSRWQQG NVFSCSVMHE ALHNHYTQKS LSLSPG (21-240) | AGS (247-249) | QCGQKTLRP RFK (250-261) | IIGGEFTTIE NQPWFAAIYQ RYEGGSEYYR CGGSLISPCW VISATHCFIP QPKKEDYIVY LGRSRLNSNT QGEMKFEVEN LILHKDYSAD IAAQHNDIAL LKIRSKEGRC AQPSRTIQTI CLPSMYNDPQ FGTSCEITGF GKENSTDRLY PEQLKMTVVK LISHRECQQP HYYGSEVTTK MLCAADPQWK TDSCQGDSGG PLVCSLQGRM TLTGIVSWGR GCALKDPGV YTRVSHFLPW IRSHTKEEN GLAL (262-514) | |

-continued

| Seq ID No. | Name | Sequence signal (residue nos.) | Fusion partner (residue nos.) | Linker (residue nos.) | Activation Sequence (residue nos.) | Catalytic domain (residue nos.) | Other N terminal domain (residue nos.) |
|---|---|---|---|---|---|---|---|
| 1005 | N-term u-PA-u-PA (SEQ ID NO: 987) | METDTLLL WVLLLWVP GSTG (1-20) | — | — | QCGQKTLRP RFK (167-178) | IIGGEFTTIE NQPWFAAIYQ RYEGGSEYYR CGGSLISPCW VISATHCFIP QPKKEDYIVY LGRSRLNSNT QGEMKFEVEN LILHKDYSAD IAAQHNDIAL LKIRSKEGRC AQPSRTIQTI CLPSMYNDPQ FGTSCEITGF GKENSTDRLY PEQLKMTVVK LISHRECQQP HYYGSEVTTK MLCAADPQWK TDSCQGDSGG PLVCSLQGRM TLTGIVSWGR GCALKDKPGV YTRVSHFLPW IRSHTKEENG LAL (179-431) | SNELHQVPSN CDCLNGGTCV SNKYFSNIHW CNCPKKFGGQ HCEIDKSKTC YEGNGHFYRG KASTDTMGRP CLPWNSATVL QQTYHAHRSD ALQLGLGKHN YCRNPDNRRR PWCYVQVGLK PLVQECMVHD CADGKKPSSP PEELKF (21-166) |

* u-PA protease domain of SEQ ID NO: 21 (with and without the C122S replacement)

FIG. 2 sets forth schematics of the u-PA polypeptides with N-terminal fusions, such as the N-terminal fusion polypeptides set forth in SEQ ID NOS: 1004 and 1005.

8. Exemplary Modified u-PA Polypeptides with C-Terminal Fusions

| SEQ ID No. | Name | Sequence signal (residue nos.) | Catalytic domain | Linker (residue nos.) | Activation Sequence | Fusion partner | Other N terminal domain |
|---|---|---|---|---|---|---|---|
| 1006 | uPA (SEQ ID NO: 21)-Fc (No PP) | MYRMQLLSCI ALSLALVTNS (1-20) | IIGGEFTTIENQP WFAAIYQRYEGGS EYYRCGGSLISPC WVISATHCFIPQP KKEDYIVYLGRSR LNSNTQGEMKFEV ENLILHKDYSADI AAQHNDIALLKIR SKEGRCAQPSRTI QTISLPSMYNDPQ FGTSCEITGFGKE NSTDRLYPEQLKM TVVKLISHRECQQ PHYYGSEVTTKML CAADPQWKTDSCQ GDSGGPLVCSLQG RMTLTGIVSWGRG CALKDKPGVYTRV SHFLPWIRSHTKE ENG LAL (21-273) | GGSSGG (274-279) | None | DKTHTCPPCPAPELL GGPSVFLFPPKPKDT LMISRTPEVTCVVVD VSHEDPEVKFNWYVD GVEVHNAKTKPREEQ YNSTYRVVSVLTVLH QDWLNGKEYKCKVSN KALPAPIEKTISKAK GQPREPQVYTLPPSR DELTKNQVSLTCLVK GFYPSDIAVEWESNG QPENNYKTTPPVLDS DGSFFLYSKLTVDKS RWQQGNVFSCSVMHE ALHNHYTQKSL SLSPG (280-505) | |
| 1007 | uPA (SEQ ID NO: 21)-HSA (No PP) | MYRMQLLSCI ALSLALVTNS (1-20) | IIGGEFTTIE NQPWFAAIYQ RYEGGSEYYR CGGSLISPCW VISATHCFIP QPKKEDYIVY LGRSRLNSNT QGEMKFEVEN | GGSSGG (274-279) | None | DAHKSEVAHRFKDLG EENFKALVLIAFAQY LQQCPFEDHVKLVNE VTEFAKTCVADESAE NCDKSLHTLFGDKLC TVATLRETYGEMADC CAKQEPERNECFLQH KDDNPNLPRLVRPEV | |

-continued

| SEQ ID No. | Name | Sequence signal (residue nos.) | Catalytic domain | Linker (residue nos.) | Activation Sequence | Fusion partner | Other N terminal domain |
|---|---|---|---|---|---|---|---|
| | | | LILHKDYSAD IAAQHNDIAL LKIRSKEGRC AQPSRTIQTI SLPSMYNDPQ FGTSCEITGF GKENSTDRLY PEQLKMTVVK LISHRECQQP HYYGSEVTTK MLCAADPQWK TDSCQGDSGG PLVCSLQGRM TLTGIVSWGR GCALKDKPGV YTRVSHFLPW IRSHTKEENG LAL (21-273) | | | DVMCTAFHDNEETFL KKYLYEIARRHPYFY APELLFFAKRYKAAF TECCQAADKAACLLP KLDELRDEGKASSAK QRLKCASLQKFGERA FKAWAVARLSQRFPK AEFAEVSKLVTDLTK VHTECCHGDLLECAD DRADLAKYICENQDS ISSKLKECCEKPLLE KSHCIAEVENDEMPA DLPSLAADFVESKDV CKNYAEAKDVFLGMF LYEYARRHPDYSVVL LLRLAKTYETTLEKC CAAADPHECYAKVFD EFKPLVEEPQNLIKQ NCELFEQLGEYKFQN ALLVRYTKKVPQVST PTLVEVSRNLGKVGS KCCKHPEAKRMPCAE DYLSVVLNQLCVLHE KTPVSDRVTKCCTES LVNRRPCFSALEVDE TYVPKEFNAETFTFH ADICTLSEKERQIKK QTALVELVKHKPKAT KEQLKAVMDDFAAFV EKCCKADDKETCFAE EGKKLVAASQA ALGL (280-864) | |
| 1008 | uPA (SEQ ID NO: 21)- C2scFv (No PP) | MYRMQLLSCI ALSLALVTNS (1-20) | IIGGEFTTIE NQPWFAAIYQ RYEGGSEYYR CGGSLISPCW VISATHCFIP QPKKEDYIVY LGRSRLNSNT QGEMKFEVEN LILHKDYSAD IAAQHNDIAL LKIRSKEGRC AQPSRTIQTI SLPSMYNDPQ FGTSCEITGF GKENSTDRLY PEQLKMTVVK LISHRECQQP HYYGSEVTTK MLCAADPQWK TDSCQGDSGG PLVCSLQGRM TLTGIVSWGR GCALKDKPGV YTRVSHFLPW IRSHTKEENG LAL (21-273) | GGSSGG (274-279) | None | QVQLQQPGADLVRPG VSVKLSCKASGYTFT SYWMNWVKQRPGQGL EWIGMIHPSDSETRL SQKFKDKATLTVDKS SSTAYMQLSSPTSED SAVYYCARLKPGGTW FAYWGQGTLVTVSAG GGGSGGGGSGGGGSG GSDIVLTQSPASLTV SLGQRATISCRASKS VDSYGNSFMEWYQQK PGQPPKLLIYRASNL ESGIPARFSGSGSRT DFTLTINPVEADDVA TYYCQQSNEDPYTFG GGTKLEIK (280-527) | |
| 1009 | uPA (SEQ ID NO: 21)- HABD (No PP) | MYRMQLLSCI ALSLALVTNS (1-20) | IIGGEFTTIENQP WFAAIYQRYEGGS EYYRCGGSLISPC WVISATHCFIPQP KKEDYIVYLGRSR LNSNTQGEMKFEV ENLILHKDYSAD IAAQHNDIAL LKIRSKEGRC AQPSRTIQTI SLPSMYNDPQ FGTSCEITGF | GGSSGG (274-279) | None | ERAAGVYHRE ARSGKYKLTY AEAKAVCEFE GGHLATYKQL EAARKIGFHV CAAGWMAKGR VGYPIVKPGP NCGFGKTGII DYGIRLNRSE RWDAYCYNPH A KE (280-382) | |

-continued

| SEQ ID No. | Name | Sequence signal (residue nos.) | Catalytic domain | Linker (residue nos.) | Activation Sequence | Fusion partner | Other N terminal domain |
|---|---|---|---|---|---|---|---|
| | | | GKENSTDRLY PEQLKMTVVK LISHRECQQP HYYGSEVTTK MLCAADPQWK TDSCQGDSGG PLVCSLQGRM TLTGIVSWGR GCALKDKPGV YTRVSHFLPW IRSHTKEENG LAL (21-273) | | | | |
| 1010 | uPA (SEQ ID NO: 21)-Fc (Furin) | METDTLLLWV LLLWVPGSTG (1-20) | IIGGEFTTIENQP WFAAIYQRYEGGS EYYRCGGSLISPC WVISATHCFIPQP KKEDYIVYLGRSR LNSNTQGEMKFEV ENLILHKDYSADI AAQHNDIALLKIR SKEGRCAQPSRTI QTISLPSMYNDPQ FGTSCEITGFGKE NSTDRLYPEQLKM TVVKLISHRECQQ PHYYGSEVTTKML CAADPQWKTDSCQ GDSGGPLVCSLQG RMTLTGIVSWG R GCALKDKPGVYTR VSHFLPWIRSHTK EENGLAL (32-284) | GGSSGG (285-290) | QSGQKTL RRKR (21-31) | DKTHTCPPCP APELLGGPSV FLFPPKPKDT LMISRTPEVT CVVVDVSHED PEVKFNWYVD GVEVHNAKTK PREEQYNSTY RVVSVLTVLH QDWLNGKEYK CKVSNKALPA PIEKTISKAK GQPREPQVYT LPPSRDELTK NQVSLTCLVK GFYPSDIAVE WESNGQPENN YKTTPPVLDS DGSFFLYSKL TVDKSRWQQG NVFSCSVMHE ALHNHYTQKS LSLSPG (291-516) | |
| 1011 | uPA N-Term-uPA (SEQ ID NO: 987)-Fc | METDTLLLWV LLLWVPGSTG (1-20) | IIGGEFTTIENQ PWFAAIYQRYEG GSEYYRCGGSLI SPCWVISATHCF IPQPKKEDYIVY LGRSRLNSNTQG EMKFEVENLILH KDYSADIAAQHN DIALLKIRSKEG RCAQPSRTIQTI CLPSMYNDPQFG TSCEITGFGKEN STDRLYPEQLKM TVVKLISHRECQ QPHYYGSEVTTK MLCAADPQWKTD SCQGDSGGPLVC SLQGRMTLTGIV SWGRGCALKDKP GVYTRVSHFLPW IRSHTKEENGLA L (179-431) | GGSSGG (432-437) | QCGQ KTLRPRFK (167-178) | DKTHTCPPCP APELLGGPSV FLFPPKPKDT LMISRTPEVT CVVVDVSHED PEVKFNWYVD GVEVHNAKTK PREEQYNSTY RVVSVLTVLH QDWLNGKEYK CKVSNKALPA PIEKTISKAK GQPREPQVYT LPPSRDELTK NQVSLTCLVK GFYPSDIAVE WESNGQPENN YKTTPPVLDS DGSFFLYSKL TVDKSRWQQG NVFSCSVMHE ALHNHYTQKS LSLSPG (438-663) | SNELHQVPSNCDCL NGGTCVSNKYFSNI HWCNCPKKFGGQHC EIDKSKTCYEGNGH FYRGKASTDTMGRP CLPWNSATVLQQTY HAHRSDALQLGLGK HNYCRNPDNRRRPW CYVQVGLKPLVQEC MVHD CADGKKPSS PPEELKF (21-166) |
| 1012 | WT uPA with C122S-Fc (No PP) | MYRMQLLSCI ALSLALVTNS (1-20) | IIGGEFTTIENQP WFAAIYRRHRGGS VTYVCGGSLMSPC WVISATHCFIDYP KKEDYIVYLGRSR LNSNTQGEMKFEV ENLILHKDYSADT LAHHNDIALLKIR SKEGRCAQPSRTI QTISLPSMYNDPQ | GGSSGG (274-279) | None | DKTHTCPPCPAPELL GGPSVFLFPPKPKDT LMISRTPEVTCVVVD VSHEDPEVKFNWYVD GVEVHNAKTKPREEQ YNSTYRVVSVLTVLH QDWLNGKEYKCVSN KALPAPIEKTISKAK GQPREPQVYTLPPSR DELTKNQVSLTCLVK | |

| SEQ ID No. | Name | Sequence signal (residue nos.) | Catalytic domain | Linker (residue nos.) | Activation Sequence | Fusion partner | Other N terminal domain |
|---|---|---|---|---|---|---|---|
| | | | FGTSCEITGFGKE NSTDYLYPEQLKM TVVKLISHRECQQ PHYYGSEVTTKML CAADPQWKTDSCQ GDSGGPLVCSLQG RMTLTGIVSWGRG CALKDKPGVYTRV SHFLPWIRSHTKE ENG LAL (21-273) | | | GFYPSDIAVEWESNG QPENNYKTTPPVLDS DGSFFLYSKLTVDKS RWQQGNVFSCSVMHE ALHNHYTQKS LSLS PG (280-505) | |
| 1013 | WT uPA with C122S - HSA (No PP) | MYRMQLLSCI ALSLALVTNS (1-20) | IIGGEFTTIEN QPWFAAIYRRH RGGSVTYV CGGSLMSPCW VISATHCFID YPKKEDYIVY LGRSRLNSNT QGEMKFEVEN LILHKDYSAD TLAHHNDIAL LKIRSKEGRC AQPSRTIQTI SLPSMYNDPQ FGTSCEITGF GKENSTDYLY PEQLKMTVVK LISHRECQQP HYYGSEVTTK MLCAADPQWK TDSCQGDSGG PLVCSLQGRM TLTGIVSWGR GCALKDKPGV YTRVSHFLPW IRSHTKEENG LAL (21-273) | GGSSGG (274-279) | None | DAHKSEVAHRFKDLG EENFKALVLIAFAQY LQQCPFEDHVKLVNE VTEFAKTCVADESAE NCDKSLHTLFGDKLC TVATLRETYGEMADC CAKQEPERNECFLQH KDDNPNLPRLVRPEV DVMCTAFHDNEETFL KKYLYEIARRHPYFY APELLFFAKRYKAAF TECCQAADKAACLLP KLDELRDEGKASSAK QRLKCASLQKFGERA FKAWAVARLSQRFPK AEFAEVSKLVTDLTK VHTECCHGDLLECAD DRADLAKYICENQDS ISSKLKECCEKPLLE KSHCIAEVENDEMPA DLPSLAADFVESKDV CKNYAEAKDVFLGMF LYEYARRHPDYSVVL LLRLAKTYETTLEKC CAAADPHECYAKVFD EFKPLVEEPQNLIKQ NCELFEQLGEYKFQN ALLVRYTKKVPQVST PTLVEVSRNLGKVGS KCCKHPEAKRMPCAE DYLSVVLNQLCVLHE KTPVSDRVTKCCTES LVNRRPCFSALEVDE TYVPKEFNAETFTFH ADICTLSEKERQIKK QTALVELVKHKPKAT KEQLKAVMDDFAAFV EKCCKADDKETCFAE EGKKLVAASQAALGL (280-864) | |
| 1036 | uPA N-term- uPA (SEQ ID NO: 987)- Fc (Furin) | METDTLLLWV LLLWVPGSTG (1-20) | IIGGEFTTIENQ PWFAAIYQRYEG GSEYYRCGGSLI SPCWVISATHCF IPQPKKEDYIVY LGRSRLNSNTQG EMKFEVENLILH KDYSADIAAQHN DIALLKIRSKEG RCAQPSRTIQTI CLPSMYNDPQFG TSCEITGFGKEN STDRLYPEQLKM TVVKLISHRECQ QPHYYGSEVTTK MLCAADPQWKTD SCQGDSGGPLVC SLQGRMTLTGIV SWGRGCALKDKP | GGSSGG (432-437) | QCGQ KTLRRRKR (167-178) | DKTHTCPPCPAPELL GGPSVFLFPPKPKDT LMISRTPEVTCVVVD VSHEDPEVKFNWYVD GVEVHNAKTKPREEQ YNSTYRVVSVLTVLH QDWLNGKEYKCKVSN KALPAPIEKTISKAK GQPREPQVYTLPPSR DELTKNQVSLTCLVK GFYPSDIAVEWESNG QPENNYKTTPPVLDS DGSFFLYSKLTVDKS RWQQGNVFSCSVMHE ALHNHYTQKS LSLS PG (438-663) | SNELHQVPSNCDC LNGGTCVSNKYFS NIHWCNCPKKFGG QHCEIDKSKTCYE GNGHFYRGKASTD TMGRPCLPWNSAT VLQQTYHAHRSDA LQLGLGKHNYCRN PDNRRRPWCYVQV GLKPLVQECMVHD CADGKKPSSPPEE LKF (21-166) |

-continued

| SEQ ID No. | Name | Sequence signal (residue nos.) | Catalytic domain | Linker (residue nos.) | Activation Sequence | Fusion partner | Other N terminal domain |
|---|---|---|---|---|---|---|---|
| | | | GVYTRVSHFLPW IRSHTKEENGLA L (179-431) | | | | |
| 1014 | uPA N-term-uPA (SEQ ID NO: 987)-HSA (Furin) | METDTLLLWV LLLWVPGSTG (1-20) | IIGGEFTTIENQ PWFAAIYQRYEG GSEYYRCGGSLI SPCWVISATHCF IPQPKKEDYIVY LGRSRLNSNTQG EMKFEVENLILH KDYSADIAAQHN DIALLKIRSKEG RCAQPSRTIQTI CLPSMYNDPQFG TSCEITGFGKEN STDRLYPEQLKM TVVKLISHRECQ QPHYYGSEVTTK MLCAADPQWKTD SCQGDSGGPLVC SLQGRMTLTGIV SWGRGCALKDKP GVYTRVSHFLPW IRSHTKEENGLA L (179-431) | GGSSGG (432-437) | QCGQ KTLRRRKR (167-178) | DAHKSEVAHRFKDLG EENFKALVLIAFAQY LQQCPFEDHVKLVNE VTEFAKTCVADESAE NCDKSLHTLFGDKLC TVATLRETYGEMADC CAKQEPERNECFLQH KDDNPNLPRLVRPEV DVMCTAFHDNEETFL KKYLYEIARRHPYFY APELLFFAKRYKAAF TECCQAADKAACLLP KLDELRDEGKASSAK QRLKCASLQKFGERA FKAWAVARLSQRFPK AEFAEVSKLVTDLTK VHTECCHGDLLECAD DRADLAKYICENQDS ISSKLKECCEKPLLE KSHCIAEVENDEMPA DLPSLAADFVESKDV CKNYAEAKDVFLGMF LYEYARRHPDYSVVL LLRLAKTYETTLEKC CAAADPHECYAKVFD EFKPLVEEPQNLIKQ NCELFEQLGEYKFQN ALLVRYTKKVPQVST PTLVEVSRNLGKVGS KCCKHPEAKRMPCAE DYLSVVLNQLCVLHE KTPVSDRVTKCCTES LVNRRPCFSALEVDE TYVPKEFNAETFTFH ADICTLSEKERQIKK QTALVELVKHKPKAT KEQLKAVMDDFAAFV EKCCKADDKETCFAE EGKKLVAASQAALGL (438-1022) | SNELHQVPSNCDCL NGGTCVSNKYFSNI HWCNCPKKFGGQHC EIDKSKTCYEGNGH FYRGKASTDTMGRP CLPWNSATVLQQTY HAHRSDALQLGLGK HNYCRNPDNRRRPW CYVQVGLKPLVQEC MVHDCADGKKPSSP PEELKF (21-166) |
| 1015 | uPA N-term-uPA (SEQ ID NO: 987)-HSA | METDTLLLWV LLLWVPGSTG (1-20) | IIGGEFTTIE NQPWFAAIYQ RYEGGSEYYR CGGSLISPCW VISATHCFIP QPKKEDYIVY LGRSRLNSNT QGEMKFEVEN LILHKDYSAD IAAQHNDIAL LKIRSKEGRC AQPSRTIQTI CLPSMYNDPQ FGTSCEITGF GKENSTDRLY PEQLKMTVVK LISHRECQQP HYYGSEVTTK MLCAADPQWK TDSCQGDSGG PLVCSLQGRM TLTGIVSWGR GCALKDKPGV YTRVSHFLPW IRSHTKEENG LA L 179-431 | GGSSGG (432-437) | QCGQ KTLRPRFK (167-178) | DAHKSEVAHRFKDLG EENFKALVLIAFAQY LQQCPFEDHVKLVNE VTEFAKTCVADESAE NCDKSLHTLFGDKLC TVATLRETYGEMADC CAKQEPERNECFLQH KDDNPNLPRLVRPEV DVMCTAFHDNEETFL KKYLYEIARRHPYFY APELLFFAKRYKAAF TECCQAADKAACLLP KLDELRDEGKASSAK QRLKCASLQKFGERA FKAWAVARLSQRFPK AEFAEVSKLVTDLTK VHTECCHGDLLECAD DRADLAKYICENQDS ISSKLKECCEKPLLE KSHCIAEVENDEMPA DLPSLAADFVESKDV CKNYAEAKDVFLGMF LYEYARRHPDYSVVL LLRLAKTYETTLEKC CAAADPHECYAKVFD EFKPLVEEPQNLIKQ NCELFEQLGEYKFQN ALLVRYTKKVPQVST | SNELHQVPSN CDCLNGGTCV SNKYFSNIHW CNCPKKFGGQ HCEIDKSKTC YEGNGHPYRG KASTDTMGRP CLPWNSATVL QQTYHAHRSD ALQLGLGKHN YCRNPDNRRR PWCYVQVGLK PLVQECMVHD CADGKKPSSP PEELKF (21-166) |

-continued

| SEQ ID No. | Name | Sequence signal (residue nos.) | Catalytic domain | Linker (residue nos.) | Activation Sequence | Fusion partner | Other N terminal domain |
|---|---|---|---|---|---|---|---|
| | | | | | | PTLVEVSRNLGKVGS KCCKHPEAKRMPCAE DYLSVVLNQLCVLHE KTPVSDRVTKCCTES LVNRRPCFSALEVDE TYVPKEFNAETFTFH ADICTLSEKERQIKK QTALVELVKHKPKAT KEQLKAVMDDFAAFV EKCCKADDKETCFAE EGKKLVAASQA ALGL (438-1022) | |
| 1016 | uPA (SEQ ID NO: 21)- HSA (Furin) | METDTLLLWV LLLWVPGSTG (1-20) | IIGGEFTTIE NQPWFAAIYQ RYEGGSEYYR CGGSLISPCW VISATHCFIP QPKKEDYIVY LGRSRLNSNT QGEMKFEVEN LILHKDYSAD IAAQHNDIAL LKIRSKEGRC AQPSRTIQTI SLPSMYNDPQ FGTSCEITGF GKENSTDRLY PEQLKMTVVK LISHRECQQP HYYGSEVTTK MLCAADPQWK TDSCQGDSGG PLVCSLQGRM TLTGIVSWGR GCALKDKPGV YTRVSHFLPW IRSHTKEENG LAL (33-285) | GGSSGG (286-291) | QSGQKTL RRRKR (21-32) | DAHKSEVAHRFKDLG EENFKALVLIAFAQY LQQCPFEDHVKLVNE VTEFAKTCVADESAE NCDKSLHTLFGDKLC TVATLRETYGEMADC CAKQEPERNECFLQH KDDNPNLPRLVRPEV DVMCTAFHDNEETFL KKYLYEIARRHPYFY APELLFFAKRYKAAF TECCQAADKAACLLP KLDELRDEGKASSAK QRLKCASLQKFGERA FKAWAVARLSQRFPK AEFAEVSKLVTDLTK VHTECCHGDLLECAD DRADLAKYICENQDS ISSKLKECCEKPLLE KSHCIAEVENDEMPA DLPSLAADFVESKDV CKNYAEAKDVFLGMF LYEYARRHPDYSVVL LLRLAKTYETTLEKC CAAADPHECYAKVFD EFKPLVEEPQNLIKQ NCELFEQLGEYKFQN ALLVRYTKKVPQVST PTLVEVSRNLGKVGS KCCKHPEAKRMPCAE DYLSVVLNQLCVLHE KTPVSDRVTKCCTES LVNRRPCFSALEVDE TYVPKEFNAETFTFH ADICTLSEKERQIKK QTALVELVKHKPKAT KEQLKAVMDDFAAFV EKCCKADDKETCFAE EGKKLVAASQAALGL (292-876) | |
| 1017 | SUMO- uPA (SEQ ID NO: 21)- HSA | METDTLLLWV LLLWVPGSTG (1-20) | IIGGEFTTIE NQPWFAAIYQ RYEGGSEYYR CGGSLISPCW VISATHCFIP QPKKEDYIVY LGRSRLNSNT QGEMKFEVEN LILHKDYSAD IAAQHNDIAL LKIRSKEGRC AQPSRTIQTI SLPSMYNDPQ FGTSCEITGF GKENSTDRLY PEQLKMTVVK LISHRECQQP HYYGSEVTTK MLCAADPQWK | GGSSGG (382-387) | — | DAHKSEVAHRFKDLG EENFKALVLIAFAQY LQQCPFEDHVKLVNE VTEFAKTCVADESAE NCDKSLHTLFGDKLC TVATLRETYGEMADC CAKQEPERNECFLQH KDDNPNLPRLVRPEV DVMCTAFHDNEETFL KKYLYEIARRHPYFY APELLFFAKRYKAAF TECCQAADKAACLLP KLDELRDEGKASSAK QRLKCASLQKFGERA FKAWAVARLSQRFPK AEFAEVSKLVTDLTK VHTECCHGDLLECAD DRADLAKYICENQDS ISSKLKECCEKPLLE | DGHHHHHHGSLQD SEVNQEAKPEVKP EVKPETHINLKVS DGSSEIFFKIKKT TPLRRLMEAFAKR QGKEMDSLTFLYD GIEIQADQTPEDL DMEDNDIIAHREQ IGG (21-128) |

-continued

| SEQ ID No. | Name | Sequence signal (residue nos.) | Catalytic domain | Linker (residue nos.) | Activation Sequence | Fusion partner | Other N terminal domain |
|---|---|---|---|---|---|---|---|
| | | | TDSCQGDSGG PLVCSLQGRM TLTGIVSWGR GCALKDKPGV YTRVSHFLPW IRSHTKEENG LAL (129-381) | | | KSHCIAEVENDEMPA DLPSLAADFVESKDV CKNYAEAKDVFLGMF LYEYARRHPDYSVVL LLRLAKTYETTLEKC CAAADPHECYAKVFD EFKPLVEEPQNLIKQ NCELFEQLGEYKFQN ALLVRYTKKVPQVST PTLVEVSRNLGKVGS KCCKHPEAKRMPCAE DYLSVVLNQLCVLHE KTPVSDRVTKCCTES LVNRRPCFSALEVDE TYVPKEFNAETFTFH ADICTLSEKERQIKK QTALVELVKHKPKAT KEQLKAVMDDFAAFV EKCCKADDKETCFAE EGKKLVAASQA ALGL (388-972) | |
| 1018 | SUMO-uPA (SEQ ID NO: 21)-Fc | METDTLLLWV LLLWVPGSTG (1-20) | IIGGEFTTIE NQPWFAAIYQ RYEGGSEYYR CGGSLISPCW VISATHCFIP QPKKEDYIVY LGRSRLNSNT QGEMKFEVEN LILHKDYSAD IAAQHNDIAL LKIRSKEGRC AQPSRTIQTI SLPSMYNDPQ FGTSCEITGF GKENSTDRLY PEQLKMTVVK LISHRECQQP HYYGSEVTTK MLCAADPQWK TDSCQGDSGG PLVCSLQGRM TLTGIVSWGR GCALKDKPGV YTRVSHFLPW IRSHTKEENG LAL (129-381) | GGSSGG (382-387) | — | DKTHTCPPCPAPELL GGPSVFLFPPKPKDT LMISRTPEVTCVVVD VSHEDPEVKFNWYVD GVEVHNAKTKPREEQ YNSTYRVVSVLTVLH QDWLNGKEYKCKVSN KALPAPIEKTISKAK GQPREPQVYTLPPSR DELTKNQVSLTCLVK GFYPSDIAVEWESNG QPENNYKTTPPVLDS DGSFFLYSKLTVDKS RWQQGNVFSCSVMHE ALHNHYTQKSLSLSP G (388-613) | DGHHHHHHGSLQD SEVNQEAKPEVKP EVKPETHINLKVS DGSSEIFFKIKKT TPLRRLMEAFAKR QGKEMDSLTFLYD GIEIQADQTPEDL DMEDNDIIEAHRE QIGG (21-128) |
| 1037 | 6xHis-sumo-uPA (SEQ ID NO: 987) | — | IIGGEFTTIENQ PWFAAIYQRYEG GSEYYRCGGSLI SPCWVISATHCF IPQPKKEDYIVY LGRSRLNSNTQG EMKFEVENLILH KDYSADIAAQHN DIALLKIRSKEG RCAQPSRTIQTI CLPSMYNDPQFG TSCEITGFGKEN STDRLYPEQLKM TVVKLISHRECQ QPHYYGSEVTTK MLCAADPQWKTD SCQGDSGGPLVC SLQGRMTLTGIV SWGRGCALKDKP GVYTRVSHFLPW IRSHTKEENGLA L (109-361) | | — | | MGHHHHHHGSLQD SEVNQEAKPEVKP EVKPETHINLKVS DGSSEIFFKIKKT TPLRRLMEAFAKR QGKEMDSLRFLYD GIRIQADQAPEDL DMEDNDIIEAHRE QIGG (1-108) |

| SEQ ID No. | Name | Sequence signal (residue nos.) | Catalytic domain | Linker (residue nos.) | Activation Sequence | Fusion partner | Other N terminal domain |
|---|---|---|---|---|---|---|---|
| 1038 | 6xHis sumo-uPA (SEQ ID NO: 21) | — | IIGGEFTTIENQ PWFAAIYQRYEG GSEYYRCGGSLI SPCWVISATHCF IPQPKKEDYIVY LGRSRLNSNTQG EMKFEVENLILH KDYSADIAAQHN DIALLKIRSKEG RCAQPSRTIQTI SLPSMYNDPQFG TSCEITGFGKEN STDRLYPEQLKM TVVKLISHRECQ QPHYYGSEVTTK MLCAADPQWKTD SCQGDSGGPLVC SLQGRMTLTGIV SWGRGCALKDKP GVYTRVSHFLPW IRSHTKEENGLA L (109-361) | | — | | MGHHHHHHGSLQD SEVNQEAKPEVKP EVKPETHINLKVS DGSSEIFFKIKKT TPLRRLMEAFAKR QGKEMDSLRFLYD GIRIQADQAPEDL DMEDNDIIEAHRE QIGG (1-108) |
| 1039 | 6xHis sum-uPA (SEQ ID NO: 21)-GGSCK | — | IIGGEFTTIENQ PWFAAIYQRYEG GSEYYRCGGSLI SPCWVISATHCF IPQPKKEDYIVY LGRSRLNSNTQG EMKFEVENLILH KDYSADIAAQHN DIALLKIRSKEG RCAQPSRTIQTI SLPSMYNDPQFG TSCEITGFGKEN STDRLYPEQLKM TVVKLISHRECQ QPHYYGSEVTTK MLCAADPQWKTD SCQGDSGGPLVC SLQGRMTLTGIV SWGRGCALKDKP GVYTRVSHFLPW IRSHTKEENGLA L (109-361) | | — | GGSCK (362-366) | MGHHHHHHGSLQD SEVNQEAKPEVKP EVKPETHINLKVS DGSSEIFFKIKKT TPLRRLMEAFAKR QGKEMDSLRFLYD GIRIQADQAPEDL DMEDNDIIEAHRE QIGG (1-108) |

FIG. 3 sets forth schematics of the u-PA polypeptides with C-terminal fusions, such as the C-terminal fusion polypeptides set forth in SEQ ID NOS: 1006-1018 and 1036.

I. Assays for Assessing u-PA Amounts and Complement Pathway Activity

The u-PA polypeptide fusions were produced after transfection of the pcDNA3_4 vector encoding altered and native u-PA polypeptide fusion in a mammalian expression system in Expi293™ cells. The u-PA polypeptides that correctly expressed in Expi293™ cells were purified on a HiTrap Protein A HP or CaptureSelect™ Human Albumin Affinity Matrix and processed for bioanalytical assays such as a u-PA ELISA to examine the uPA titers or a C3 FRET proteolytic cleavage assay to examine u-PA polypeptide catalytic activity. The results are set forth in the table below:

| SEQ ID NO: | A280 | Total amount of protein from 1 L culture' | uPA ELISA titer (mg/L) | uPA ELISA titer (mg/L) | Proteolytic activity on C3 relative to A280 | Proteolytic activity on C3 relative to uPA ELISA titer |
|---|---|---|---|---|---|---|
| 1004 | | | 0.4 | 0.4 | | |
| 1005 | | | 149.7 | 75.39 | | |
| 1006 | | | 2.6 | 2.2 | | |
| 1007 | | | 0.3 | 0.3 | | |
| 1008 | | | 0.1 | 0.06 | | |
| 1009 | | | 0.3 | 0.26 | | |
| 1010 | 4.23 mg/ml | 36.4 mg | 17.3 | 15.89 | 110.36 | 773.05 |
| 1011 | 1.69 mg/ml | 23.0 mg | 19.3 | 21.66 | 0.06 | 0.1 |
| 1012 | | | 16.2 | 7.5 | | |
| 1013 | | | 4.7 | 5.46 | | |
| 1036 | 3.32 mg/ml | 42.5 mg | | | | |
| 1014 | | | | | | |
| 1015u | 3.43 mg/ml | 70.3 mg | | | | |
| 1015a | 1.16 mg/ml | 44.7 mg | | | | |
| 1015i | | | | | | |
| 1016 | | | | | | |
| 1017 | 3.32 mg/ml | 89.3 mg | | | | |
| 1018 | 1.10 mg/ml | 11 mg | | | | |

1. u-PA ELISA Levels

An enzyme linked immunosorbent assay (ELISA) is used to measure the presence of u-PA polypeptides (see, e.g., Example 15). Typically, the measurement of u-PA is an indirect measure of the binding of u-PA to a capture antibody (PA1-36166 at 1.0 ug/mL, Invitrogen). The captured u-PA polypeptide is then detected with a detection antibody (PA1-36015 at 0.25 ug/mL) which is recognized by the HRP conjugated anti Goat antibody (Rockland, 605-403-B69). The HRP enzyme triggers a colorimetric reaction upon addition of the TMB substrate. Using the u-PA ELISA method, four u-PA polypeptides were identified to express at high uPA titer levels (SEQ ID NOS: 1005, 1010, 1011, 1012, 1015), two u-PA polypeptides at medium titers (SEQ ID NOS: 1006 and 1013), and u-PA polypeptides set forth in SEQ ID NOS: 1004, 1007-1009 did not express.

2. Enzyme Activity (Human C3 FRET Peptide).

The proteolytic activity of uPA polypeptides on human C3 was measured in vitro using a human C3 FRET peptide RHQARASHL EDANS/DABCYL produced by Genscript (lot #94045990005/PE6379) (see, e.g., Example 15). The N-terminal side of the peptide is labeled with a DABCYL fluorophore, and the C-terminal side is labeled with an EDANS fluorophore. Cleavage of the peptide separates the EDANS/DABCYL FRET pair to generate a fluorescent signal, which is measured in a multi-well plate reader. The rate of generation of fluorescence intensity is interpolated against an EDANS standard curve to yield the EDANS product generation rate. The product generation rate is multiplied by the dilution factor to yield a volumetric specific activity in units of nmol product per minute of reaction per mL of sample (nmol/min/mL). The volumetric specific activity indicates the total amount of active enzyme in the sample. The second specific activity is calculated by dividing the volumetric specific activity by the sample enzyme concentration to yield an enzyme specific activity in units of nmol product per minute of reaction per mg of enzyme (nmol/min/mg). The enzyme specific activity indicates the intrinsic activity of uPA polypeptides in the sample regardless of the concentration. Using the human C3 FRET activity assay, uPA polypeptide set forth in SEQ ID NO: 1010 was shown to be active.

Since modifications will be apparent to those of skill in this art, it is intended that this invention be limited only by the scope of the appended claims.

SEQUENCE LISTING (1044 sequences)

SEQ ID NO: 1 - protein, 431 aa, synthetic construct
  REGION 1..431: note = UROKINASE-TYPE PLASMINOGEN ACTIVATOR (u-PA) pro-peptide
MRALLARLLLCVLVVSDSKGSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 2 - protein, 253 aa, synthetic construct
  REGION 1..253: note = UROKINASE-TYPE PLASMINOGEN ACTIVATOR (u-PA) protease domain
IIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 3 - protein, 411 aa, synthetic construct
  REGION 1..411: note = UROKINASE-TYPE PLASMINOGEN ACTIVATOR (u-PA) mature
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 4 - protein, 431 aa, synthetic construct
  REGION 1..431: note = urokinase plasminogen activator (u-PA) pro-peptide C122S
MRALLARLLLCVLVVSDSKGSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYSRNPDNRRRPWCYVQVGLKPLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 5 - protein, 253 aa, synthetic construct
  REGION 1..253: note = UROKINASE-TYPE PLASMINOGEN ACTIVATOR (u-PA) protease domain C122S
IIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 6 - protein, 411 aa, synthetic construct
  REGION 1..411: note = UROKINASE-TYPE PLASMINOGEN ACTIVATOR (u-PA) mature C122S
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 7 - DNA, 1296 bp, synthetic construct
  misc_feature 1..1296: note = UROKINASE-TYPE PLASMINOGEN ACTIVATOR (u-PA) pro-peptide
  source 1..1296: mol_type = other DNA
atgagagccctgctggcgcgcctgcttctctgcgtcctggtcgtgagcgactccaaaggcagcaatgaacttcatcaagttccatcgaactgtgactgtctaaatggaggaacatgtgtgtccaacaagtacttctccaacattcactggtgcaactgcccaaagaaattcggagggcagcactgtgaaatagataagtcaaaaacctgctatgaggggaatggtcacttttaccgaggaaaggccagcactgacaccatgggccggccctgcctgccctggaactctgccactgtccttcagcaaacgtaccatgcccacagatctgatgctcttcagctgggcctggggaaacataattactgcaggaacccagacaaccggaggcgaccctggtgctatgtgcaggtgggcctaaagccgcttgtccaagagtgcatggtgcatgactgcgcagatggaaaaaagccctcctctcctccagaagaattaaaatttcagtgtggccaaaagactctgaggccccgctttaagattattgggggagaattcaccaccatcgagaaccagccctggtttgcggccatctacaggaggcaccgggggggctctgtcacctacgtgtgtggaggcagcctcatcagcccttgctgggtgatcagcgccacacactgcttcattgattacccaaagaaggaggactacatcgtctacctgggtcgctcaaggcttaactccaacacgcaaggggagatgaagtttgaggtggaaaacctcatcctacacaaggactacagcgctgacacgcttgctcaccacaacgacattgccttgctgaagatccgttccaaggagggcaggtgtgcgcagccatcccggactatacagaccatctgcctgccctcgatgtataacgatccccagtttggcacaagctgtgagatcactggctttggaaaagagaattctaccgactatctctatccggagcagctgaaaatgactgttgtgaagctgatttcccaccgggagtgtcagcagccccactactacggctctgaagtcaccaccaaaatgctgtgtgctgctgacccacagtggaaaacagattcctgccagggagactcagggggacccctcgtctgttccctccaaggccgcatgactttgactggaattgtgagctggggccgtggatgtgccctgaaggacaagccaggcgtctacacgagagtctcacacttcttaccctggatccgcagtcacaccaaggaagagaatggcctggccctctga

SEQ ID NO: 8 - protein, 253 aa, synthetic construct
  REGION 1..253: note = UROKINASE-TYPE PLASMINOGEN ACTIVATOR (u-PA) protease domain F30Y/V38D/Y40H/V41R/L97bA/H99Q/C122S/M157K
IIGGEFTTIENQPWYAAIYRRHRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 9 - protein, 253 aa, synthetic construct
  REGION 1..253: note = UROKINASE-TYPE PLASMINOGEN ACTIVATOR (u-PA) protease domain F30Y/R35W/R36H/H37E/V38E/T39W/Y40H/V41R/Y60bQ/T97a E/L97bA/H99Q/C122S/Y149K/M157K
IIGGEFTTIENQPWYAAIYWHERGGSEWHRCGGSLISPCWVISATHCFIDQPKKEDYIVYLGRSRLNSNTQGEMKFEVENLILHKDYSADEAAQHNDIALLKIRSKEGRCAQPSRTIQTISLPSMYNDPQFGTSCEITGFGKENSTDKLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 10 - protein, 253 aa, synthetic construct
  REGION 1..253: note = UROKINASE-TYPE PLASMINOGEN ACTIVATOR (u-PA) protease domain F30Y/R35W/R36H/H37D/V38E/T39Y/Y40F/V41R/T97aI/L97b A/H99Q/C122S/Y149R/M157K
IIGGEFTTIENQPWYAAIYWHDRGGSEYFRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 11 - protein, 253 aa, synthetic construct
  REGION 1..253: note = UROKINASE-TYPE PLASMINOGEN ACTIVATOR (u-PA) protease domain R35W/R36H/H37N/V38E/T39F/Y40F/V41R/T97aI/L97bA/H99 Q/C122S/Y149R/M157K/Q192H
IIGGEFTTIENQPWFAAIYWHNRGGSEFFRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCHGDSGGPLVCSLQGRMTLTGIVSWGRGCALKDKPGVYTRVSHFLPWIRSHTKEENGLAL

SEQ ID NO: 12 - protein, 253 aa, synthetic construct
  REGION 1..253: note = UROKINASE-TYPE PLASMINOGEN ACTIVATOR (u-PA) protease domain F30Y/R35Y/R36H/H37K/V38E/T39F/Y40F/V41R/T97aI/L97b A/H99Q/C122S/Y149R/M157K
IIGGEFTTIENQPWYAAIYYHKRGGSEFFRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 13 - protein, 253 aa, synthetic construct
  REGION 1..253: note = UROKINASE-TYPE PLASMINOGEN ACTIVATOR (u-PA) protease domain F30Y/R35W/R36H/H37N/V38E/T39Y/Y40F/V41R/Y60bS/T97a E/L97bA/H99Q/C122S/Y149K/M157K
IIGGEFTTIENQPWYAAIYWHNRGGSEYFRCGGSLISPCWVISATHCFIDSPKKEDYIVYLGRSRLNSNTQGEMKFEVENLILHKDYSADEAAQHNDIALLKIRSKEGRCAQPSRTIQTISLPSMYNDPQFGTSCEITGFGKENSTDKLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 14 - protein, 253 aa, synthetic construct
  REGION 1..253: note = UROKINASE-TYPE PLASMINOGEN ACTIVATOR (u-PA) protease domain F30Y/R35W/R36H/H37P/V38E/T39Y/Y40F/V41R/Y60bS/T97a E/L97bA/H99Q/C122S/Y149K/M157K
IIGGEFTTIENQPWYAAIYWHPRGGSEYFRCGGSLISPCWVISATHCFIDSPKKEDYIVYLGRSRLNSNTQGEMKFEVENLILHKDYSADEAAQHNDIALLKIRSKEGRCAQPSRTIQTISLPSMYNDPQFGTSCEITGFGKENSTDKLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 15 - protein, 253 aa, synthetic construct
  REGION 1..253: note = UROKINASE-TYPE PLASMINOGEN ACTIVATOR (u-PA) protease domain V38E/Y40Q/V41L/Y60bL/L97bA/H99Q/C122S
IIGGEFTTIENQPWFAAIYRRHRGGSETQLCGGSLISPCWVISATHCFIDLPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 16 - protein, 253 aa, synthetic construct
  REGION 1..253: note = UROKINASE-TYPE PLASMINOGEN ACTIVATOR (u-PA) protease domain F30Y/R35Q/R36H/H37G/R37aE/V38E/T39F/Y40F/V41R/D60a P/Y60bS/T97aI/L97bA/H99Q/C122S/Y149R/M157K
IIGGEFTTIENQPWYAAIYQHGEGGSEFFRCGGSLISPCWVISATHCFIPSPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 17 - protein, 253 aa, synthetic construct
  REGION 1..253: note = UROKINASE-TYPE PLASMINOGEN ACTIVATOR (u-PA) protease domain F30Y/R35Y/R36H/H37P/R37aQ/V38E/T39Y/Y40F/V41R/Y60b H/T97aI/L97bA/H99Q/C122S/Y149R/M157K
IIGGEFTTIENQPWYAAIYYHPQGGSEYFRCGGSLISPCWVISATHCFIDHPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 18 - protein, 253 aa, synthetic construct
  REGION 1..253: note = UROKINASE-TYPE PLASMINOGEN ACTIVATOR (u-PA) protease domain R35Q/H37Y/R37aE/V38E/T39Y/V41R/D60aT/Y60bT/T97aI/L 97bA/H99Q/C122S/Y149R
IIGGEFTTIENQPWFAAIYQRYEGGSEYYRCGGSLISPCWVISATHCFITTPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 19 - protein, 253 aa, synthetic construct
  REGION 1..253: note = UROKINASE-TYPE PLASMINOGEN ACTIVATOR (u-PA) protease domain R35W/H37P/R37aN/V38E/T39Y/V41R/D60aP/Y60bL/T97aI/L 97bA/H99Q/C122S/Y149R
IIGGEFTTIENQPWFAAIYWRPNGGSEYYRCGGSLISPCWVISATHCFIPLPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 20 - protein, 253 aa, synthetic construct
  REGION 1..253: note = UROKINASE-TYPE PLASMINOGEN ACTIVATOR (u-PA) protease domain R35W/H37D/R37aP/V38E/T39W/V41R/Y60bA/T97aI/L97bA/H 99Q/C122S/Y149R
IIGGEFTTIENQPWFAAIYWRDPGGSEWYRCGGSLISPCWVISATHCFIDAPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 21 - protein, 253 aa, synthetic construct
  REGION 1..253: note = UROKINASE-TYPE PLASMINOGEN ACTIVATOR (u-PA) protease domain R35Q/H37Y/R37aE/V38E/T39Y/V41R/D60aP/Y60bQ/T97aI/L 97bA/H99Q/C122S/Y149R
IIGGEFTTIENQPWFAAIYQRYEGGSEYYRCGGSLISPCWVISATHCFIPQPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 22 - protein, 253 aa, synthetic construct
  REGION 1..253: note = UROKINASE-TYPE PLASMINOGEN ACTIVATOR (u-PA) protease domain H37Y/R37aE/V38E/T39Y/V41R/D60aP/Y60bQ/T97aI/L97bA/ H99Q/C122S/Y149R
IIGGEFTTIENQPWFAAIYRRYEGGSEYYRCGGSLISPCWVISATHCFIPQPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 23 - protein, 253 aa, synthetic construct
  REGION 1..253: note = UROKINASE-TYPE PLASMINOGEN ACTIVATOR (u-PA) protease domain R35Q/R37aE/V38E/T39Y/V41R/D60aP/Y60bQ/T97aI/L97bA/ H99Q/C122S/Y149R
IIGGEFTTIENQPWFAAIYQRHEGGSEYYRCGGSLISPCWVISATHCFIPQPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 24 - protein, 253 aa, synthetic construct
  REGION 1..253: note = UROKINASE-TYPE PLASMINOGEN ACTIVATOR (u-PA) protease domain R35Q/H37Y/V38E/T39Y/V41R/D60aP/Y60bQ/T97aI/L97bA/H 99Q/C122S/Y149R
IIGGEFTTIENQPWFAAIYQRYRGGSEYYRCGGSLISPCWVISATHCFIPQPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 25 - protein, 253 aa, synthetic construct
  REGION 1..253: note = UROKINASE-TYPE PLASMINOGEN ACTIVATOR (u-PA) protease domain R35Q/H37Y/R37aE/T39Y/V41R/D60aP/Y60bQ/T97aI/L97bA/ H99Q/C122S/Y149R
IIGGEFTTIENQPWFAAIYQRYEGGSVYYRCGGSLISPCWVISATHCFIPQPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 26 - protein, 253 aa, synthetic construct
  REGION 1..253: note = UROKINASE-TYPE PLASMINOGEN ACTIVATOR (u-PA) protease domain R35Q/H37Y/R37aE/V38E/V41R/D60aP/Y60bQ/T97aI/L97bA/ H99Q/C122S/Y149R
IIGGEFTTIENQPWFAAIYQRYEGGSETYRCGGSLISPCWVISATHCFIPQPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 27 - protein, 253 aa, synthetic construct
  REGION 1..253: note = UROKINASE-TYPE PLASMINOGEN ACTIVATOR (u-PA) protease domain R35Q/H37Y/R37aE/V38E/T39Y/D60aP/Y60bQ/T97aI/L97bA/ H99Q/C122S/Y149R
IIGGEFTTIENQPWFAAIYQRYEGGSEYYVCGGSLISPCWVISATHCFIPQPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 28 - protein, 253 aa, synthetic construct
  REGION 1..253: note = UROKINASE-TYPE PLASMINOGEN ACTIVATOR (u-PA) protease domain R35Q/H37Y/R37aE/V38E/T39Y/V41R/Y60bQ/T97aI/L97bA/H 99Q/C122S/Y149R
IIGGEFTTIENQPWFAAIYQRYEGGSEYYRCGGSLISPCWVISATHCFIDQPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 29 - protein, 253 aa, synthetic construct
  REGION 1..253: note = UROKINASE-TYPE PLASMINOGEN ACTIVATOR (u-PA) protease domain R35Q/H37Y/R37aE/V38E/T39Y/V41R/D60aP/T97aI/L97bA/H 99Q/C122S/Y149R
IIGGEFTTIENQPWFAAIYQRYEGGSEYYRCGGSLISPCWVISATHCFIPYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 30 - protein, 253 aa, synthetic construct
  REGION 1..253: note = UROKINASE-TYPE PLASMINOGEN ACTIVATOR (u-PA) protease domain R35Q/H37Y/R37aE/V38E/T39Y/V41R/D60aP/Y60bQ/L97bA/H 99Q/C122S/Y149R
IIGGEFTTIENQPWFAAIYQRYEGGSEYYRCGGSLISPCWVISATHCFIPQPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 31 - protein, 253 aa, synthetic construct
  REGION 1..253: note = UROKINASE-TYPE PLASMINOGEN ACTIVATOR (u-PA) protease domain R35Q/H37Y/R37aE/V38E/T39Y/V41R/D60aP/Y60bQ/T97aI/H 99Q/C122S/Y149R
IIGGEFTTIENQPWFAAIYQRYEGGSEYYRCGGSLISPCWVISATHCFIPQPKKEDYIVYLGRSRLNSNTQGEMKFEVENLILHKDYSADILAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 32 - protein, 253 aa, synthetic construct
  REGION 1..253: note = UROKINASE-TYPE PLASMINOGEN ACTIVATOR (u-PA) protease domain R35Q/H37Y/R37aE/V38E/T39Y/V41R/D60aP/Y60bQ/T97aI/L 97bA/C122S/Y149R
IIGGEFTTIENQPWFAAIYQRYEGGSEYYRCGGSLISPCWVISATHCFIPQPKKEDYIVYLGRSRLNSNTQGEMKFEVENLILHKDYSADIAAHHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 33 - protein, 253 aa, synthetic construct
  REGION 1..253: note = UROKINASE-TYPE PLASMINOGEN ACTIVATOR (u-PA) protease domain R35Q/H37Y/R37aE/V38E/T39Y/V41R/D60aP/Y60bQ/T97aI/L 97bA/H99Q/C122S
IIGGEFTTIENQPWFAAIYQRYEGGSEYYRCGGSLISPCWVISATHCFIPQPKKEDYIVYLGRSRLNSNTQGEMKFEVENLILHKDYSADIAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 34 - protein, 253 aa, synthetic construct
  REGION 1..253: note = UROKINASE-TYPE PLASMINOGEN ACTIVATOR (u-PA) protease domain Y40Q/V41L/Y60bL/L97bA/H99Q/C122S
IIGGEFTTIENQPWFAAIYRRHRGGSVTQLCGGSLISPCWVISATHCFIDLPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 35 - protein, 253 aa, synthetic construct
  REGION 1..253: note = UROKINASE-TYPE PLASMINOGEN ACTIVATOR (u-PA) protease domain V38E/Y40Q/Y60bL/L97bA/H99Q/C122S
IIGGEFTTIENQPWFAAIYRRHRGGSETQVCGGSLISPCWVISATHCFIDLPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 36 - protein, 253 aa, synthetic construct
  REGION 1..253: note = UROKINASE-TYPE PLASMINOGEN ACTIVATOR (u-PA) protease domain V38E/Y40Q/V41L/L97bA/H99Q/C122S
IIGGEFTTIENQPWFAAIYRRHRGGSETQLCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 37 - protein, 253 aa, synthetic construct
  REGION 1..253: note = UROKINASE-TYPE PLASMINOGEN ACTIVATOR (u-PA) protease domain V38E/Y40Q/V41L/Y60bL/H99Q/C122S
IIGGEFTTIENQPWFAAIYRRHRGGSETQLCGGSLISPCWVISATHCFIDLPKKEDYIVYLGRSRLNSNTQGEMKFEVENLILHKDYSADTLAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 38 - protein, 253 aa, synthetic construct
  REGION 1..253: note = UROKINASE-TYPE PLASMINOGEN ACTIVATOR (u-PA) protease domain V38E/Y40Q/V41L/Y60bL/L97bA/C122S
IIGGEFTTIENQPWFAAIYRRHRGGSETQLCGGSLISPCWVISATHCFIDLPKKEDYIVYLGRSRLNSNTQGEMKFEVENLILHKDYSADTAAHHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 39 - protein, 253 aa, synthetic construct
  REGION 1..253: note = UROKINASE-TYPE PLASMINOGEN ACTIVATOR (u-PA) protease domain Y40Q/V41L/L97bA/H99Q/C122S
IIGGEFTTIENQPWFAAIYRRHRGGSVTQLCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 40 - protein, 253 aa, synthetic construct
  REGION 1..253: note = UROKINASE-TYPE PLASMINOGEN ACTIVATOR (u-PA) protease domain Y40Q/V41L/L97bA/C122S
IIGGEFTTIENQPWFAAIYRRHRGGSVTQLCGGSLISPCWVISATHCFIDYPKKEDYIVYLGRSRLNSNTQGEMKFEVENLILHKDYSADTAAHHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 41 - protein, 253 aa, synthetic construct
  REGION 1..253: note = UROKINASE-TYPE PLASMINOGEN ACTIVATOR (u-PA) protease domain R37aS/V41R/L97bG/H99Q/C122S
IIGGEFTTIENQPWFAAIYRRHSGGSVTYRCGGSLISPCWVISATHCFIDYPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 42 - protein, 253 aa, synthetic construct
  REGION 1..253: note = UROKINASE-TYPE PLASMINOGEN ACTIVATOR (u-PA) protease domain T39Y/V41R/L97bA/H99Q/C122S
IIGGEFTTIENQPWFAAIYRRHRGGSVYYRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 43 - protein, 253 aa, synthetic construct
  REGION 1..253: note = UROKINASE-TYPE PLASMINOGEN ACTIVATOR (u-PA) protease domain T39Y/V41R/Y60bQ/L97bA/H99Q/C122S
IIGGEFTTIENQPWFAAIYRRHRGGSVYYRCGGSLISPCWVISATHCFIDQPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 44 - protein, 253 aa, synthetic construct
  REGION 1..253: note = UROKINASE-TYPE PLASMINOGEN ACTIVATOR (u-PA) protease domain T39Y/V41R/D60aP/L97bA/H99Q/C122S
IIGGEFTTIENQPWFAAIYRRHRGGSVYYRCGGSLISPCWVISATHCFIPYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 45 - protein, 330 aa, synthetic construct [sequence omitted]

SEQ ID NO: 46 - DNA, 5132 bp, Homo sapiens
  misc_feature 1..5132: note = artificial sequence
  source 1..5132: mol_type = other DNA
agataaaaagccagctccagcaggcgctgctcactcctccccatcctctccctctgtccctctgtccctctgaccctgcactgtcccagcaccatgggacccacctcaggtcccagcctgctgctcctgctactaacccacctccccctggctctggggagtcccatgtactctatcatcacccccaacatcttgcggctggagagcgaggagaccatggtgctggaggcccacgacgcgcaaggggatgttccagtcactgttactgtccacgacttcccaggcaaaaaactagtgctgtccagtgagaagactgtgctgacccctgccaccaaccacatgggcaacgtcaccttcacgatcccagccaacagggagttcaagtcagaaaaggggcgcaacaagttcgtgaccgtgcaggccaccttcgggacccaagtggtggagaaggtggtgctggtcagcctgcagagcgggtacctcttcatccagacagacaagaccatctacacccctggctccacagttctctatcggatcttcaccgtcaaccacaagctgctacccgtgggccggacggtcatggtcaacattgagaacccggaaggcatcccggtcaagcaggactccttgtcttctcagaaccagcttggcgtcttgcccttgtcttgggacattccggaactcgtcaacatgggccagtggaagatccgagcctactatgaaaactcaccacagcaggtcttctccactgagtttgaggtgaaggagtacgtgctgcccagtttcgaggtcatagtggagcctacagagaaattctactacatctataacgagaagggcctggaggtcaccatcaccgccaggttcctctacgggaagaaagtggagggaactgcctttgtcatcttcgggatccaggatggcgaacagaggatttccctgcctgaatccctcaagcgcattccgattgaggatggctcgggggaggttgtgctgagccggaaggtactgctggacggggtgcagaacccccgagcagaagacctggtggggaagtctttgtacgtgtctgccaccgtcatcttgcactcaggcagtgacatggtgcaggcagagcgcagcgggatccccatcgtgacctctccctaccagatccacttcaccaagacacccaagtacttcaaaccaggaatgccctttgacctcatggtgttcgtgacgaaccctgatggctctccagcctaccgagtccccgtggcagtccagggcgaggacactgtgcagtctctaacccagggagatggcgtggccaaactcagcatcaacacacaccccagccagaagcccttgagcatcacggtgcgcacgaagaagcaggagctctcggaggcagagcaggctaccaggaccatgcaggctctgccctacagcaccgtgggcaactccaacaattacctgcatctctcagtgctacgtacagagctcagacccggggagaccctcaacgtcaacttcctcctgcgaatggaccgcgcccacgaggccaagatccgctactacacctacctgatcatgaacaagggcaggctgttgaaggcgggacgccaggtgcgagagcccggccaggacctggtggtgctgcccctgtccatcaccaccgacttcatcccttccttccgcctggtggcgtactacacgctgatcggtgccagcggccagagggaggtggtggccgactccgtgtgggtggacgtcaaggactcctgcgtgggctcgctggtggtaaaaagcggccagtcagaagaccggcagcctgtacctgggcagcagatgaccctgaagatagagggtgaccacggggcccgggtggtactggtggccgtggacaagggcgtgttcgtgctgaataagaagaacaaactgacgcagagtaagatctgggacgtggtggagaaggcagacatcggctgcaccccgggcagtgggaaggattacgccggtgtcttctccgacgcagggctgaccttcacgagcagcagtggccagcagaccgcccagagggcagaacttcagtgcccgcagccagccgcccgccgacgccgttccgtgcagctcacggagaagcgaatggacaaagtcggcaagtaccccaaggagctgcgcaagtgctgcgaggacggcatgcgggagaaccccatgaggttctcgtgccagcgccggacccgtttcatctccctgggcgaggcgtgcaagaaggtcttcctggactgctgcaactacatcacagagctgcggcggcagcacgcgcgggccagccacctgggcctggccaggagtaacctggatgaggacatcattgcagaagagaacatcgtttcccgaagtgagttcccagagagctggctgtggaacgttgaggacttgaaagagccaccgaaaaatggaatctctacgaagctcatgaatatatttttgaaagactccatcaccacgtgggagattctggctgtgagcatgtcggacaagaaagggatctgtgtggcagaccccttcgaggtcacagtaatgcaggacttcttcatcgacctgcggctaccctactctgttgttcgaaacgagcaggtggaaatccgagccgttctctacaattaccggcagaaccaagagctcaaggtgagggtggaactactccacaatccagccttctgcagcctggccaccaccaagaggcgtcaccagcagaccgtaaccatcccccccaagtcctcgttgtccgttccatatgtcatcgtgccgctaaagaccggcctgcaggaagtggaagtcaaggctgctgtctaccatcatttcatcagtgacggtgtcaggaagtccctgaaggtcgtgccggaaggaatcagaatgaacaaaactgtggctgttcgcaccctggatccagaacgcctgggccgtgaaggagtgcagaaagaggacatcccacctgcagacctcagtgaccaagtcccggacaccgagtctgagaccagaattctcctgcaagggaccccagtggcccagatgacagaggatgccgtcgacgcggaacggctgaagcacctcattgtgaccccctcgggctgcggggaacagaacatgatcggcatgacgcccacggtcatcgctgtgcattacctggatgaaacggagcagtgggagaagttcggcctagagaagcggcagggggccttggagctcatcaagaaggggtacacccagcagctggccttcagacaacccagctctgcctttgcggccttcgtgaaacgggcacccagcacctggctgaccgcctacgtggtcaaggtcttctctctggctgtcaacctcatcgccatcgactcccaagtcctctgcggggctgttaaatggctgatcctggagaagcagaagcccgacggggtcttccaggaggatgcgcccgtgatacaccaagaaatgattggtggattacggaacaacaacgagaaagacatggccctcacggcctttgttctcatctcgctgcaggaggctaaagatatttgcgaggagcaggtcaacagcctgccaggcagcatcactaaagcaggagacttccttgaagccaactacatgaacctacagagatcctacactgtggccattgctggctatgctctggcccagatgggcaggctgaaggggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcccgaggaggacgaatgccaagacgaagagaaccagaaacaatgccaggacctcggcgccttcaccgagagcatggttgtctttgggtgccccaactgaccacacccccattcccccactccagataaagcttcagttatatctca

SEQ ID NO: 47 - protein, 1663 aa, Homo sapiens
  REGION 1..1663: note = Complement Protein C3
MGPTSGPSLLLLLLTHLPLALGSPMYSIITPNILRLESEETMVLEAHDAQGDVPVTVTVHDFPGKKLVLSSEKTVLTPATNHMGNVTFTIPANREFKSEKGRNKFVTVQATFGTQVVEKVVLVSLQSGYLFIQTDKTIYTPGSTVLYRIFTVNHKLLPVGRTVMVNIENPEGIPVKQDSLSSQNQLGVLPLSWDIPELVNMGQWKIRAYYENSPQQVFSTEFEVKEYVLPSFEVIVEPTEKFYYIYNEKGLEVTITARFLYGKKVEGTAFVIFGIQDGEQRISLPESLKRIPIEDGSGEVVLSRKVLLDGVQNPRAEDLVGKSLYVSATVILHSGSDMVQAERSGIPIVTSPYQIHFTKTPKYFKPGMPFDLMVFVTNPDGSPAYRVPVAVQGEDTVQSLTQGDGVAKLSINTHPSQKPLSITVRTKKQELSEAEQATRTMQALPYSTVGNSNNYLHLSVLRTELRPGETLNVNFLLRMDRAHEAKIRYYTYLIMNKGRLLKAGRQVREPGQDLVVLPLSITTDFIPSFRLVAYYTLIGASGQREVVADSVWVDVKDSCVGSLVVKSGQSEDRQPVPGQQMTLKIEGDHGARVVLVAVDKGVFVLNKKNKLTQSKIWDVVEKADIGCTPGSGKDYAGVFSDAGLTFTSSSGQQTAQRAELQCPQPAARRRRSVQLTEKRMDKVGKYPKELRKCCEDGMRENPMRFSCQRRTRFISLGEACKKVFLDCCNYITELRRQHARASHLGLARSNLDEDIIAEENIVSRSEFPESWLWNVEDLKEPPKNGISTKLMNIFLKDSITTWEILAVSMSDKKGICVADPFEVTVMQDFFIDLRLPYSVVRNEQVEIRAVLYNYRQNQELKVRVELLHNPAFCSLATTKRRHQQTVTIPPKSSLSVPYVIVPLKTGLQEVEVKAAVYHHFISDGVRKSLKVVPEGIRMNKTVAVRTLDPERLGREGVQKEDIPPADLSDQVPDTESETRILLQGTPVAQMTEDAVDAERLKHLIVTPSGCGEQNMIGMTPTVIAVHYLDETEQWEKFGLEKRQGALELIKKGYTQQLAFRQPSSAFAAFVKRAPSTWLTAYVVKVFSLAVNLIAIDSQVLCGAVKWLILEKQKPDGVFQEDAPVIHQEMIGGLRNNNEKDMALTAFVLISLQEAKDICEEQVNSLPGSITKAGDFLEANYMNLQRSYTVAIAGYALAQMGRLKGPLLNKFLTTAKDKNRWEDPGKQLYNVEATSYALLALLQLKDFDFVPPVVRWLNEQRYYGGGYGSTQATFMVFQALAQYQKDAPDHQELNLDVSLQLPSRSSKITHRIHWESASLLRSEETKENEGFTVTAEGKGQGTLSVVTMYHAKAKDQLTCNKFDLKVTIKPAPETEKRPQDAKNTMILEICTRYRGDQDATMSILDISMMTGFAPDTDDLKQLANGVDRYISKYELDKAFSDRNTLIIYLDKVSHSEDDCLAFKVHQYFNVELIQPGAVKVYAYYNLEESCTRFYHPEKEDGKLNKLCRDELCRCAEENCFIQKSDDKVTLEERLDKACEPGVDYVYKTRLVKVQLSNDFDEYIMAIEQTIKSGSDEVQVGQQRTFISPIKCREALKLEEKKHYLMWGLSSDFWGEKPNLSYIIGKDTWVEHWPEEDECQDEENQKQCQDLGAFTESMVVFGCPN

SEQ ID NO: 48 - protein, 157 aa, synthetic construct
  REGION 1..157: note = uPA a chain long
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRF

SEQ ID NO: 49 - protein, 22 aa, synthetic construct
  REGION 1..22: note = uPA a chain short
KPSSPPEELKFQCGQKTLRPRF

SEQ ID NO: 50 - protein, 231 aa, synthetic construct
  REGION 1..231: note = hIgG1 Fc
PKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 51 - protein, 414 aa, synthetic construct
  REGION 1..414: note = u-PA isoform 2
MVFHLRTRYEQANCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 52 - protein, 433 aa, Mus musculus
  REGION 1..433: note = u-PA precursor
MKVWLASLFLCALVVKNSEGGSVLGAPDESNCGCQNGGVCVSYKYFSRIRRCSCPRKFQGEHCEIDASKTCYHGNGDSYRGKANTDTKGRPCLAWNAPAVLQKPYNAHRPDAISLGLGKHNYCRNPDNQKRPWCYVQIGLRQFVQECMVHDCSLSKKPSSSVDQQGFQCGQKALRPRFKIVGGEFTEVENQPWFAAIYQKNKGGSPPSFKCGGSLISPCWVASAAHCFIQLPKKENYVVYLGQSKESSYNPGEMKFEVEQLILHEYYREDSLAYHNDIALLKIRTSTGQCAQPSRSIQTICLPPRFTDAPFGSDCEITGFGKESESDYLYPKNLKMSVVKLVSHEQCMQPHYYGSEINYKMLCAADPEWKTDSCKGDSGGPLICNIEGRPTLSGIVSWGRGCAEKNKPGVYTRVSHFLDWIQSHIGEEKGLAF

SEQ ID NO: 53 - protein, 432 aa, Rattus norvegicus
  REGION 1..432: note = u-PA precursor
MRVWLASLFLCALVANSEGGSELEASDESNCGCQNGGVCVSYKYFSSIRRCSCPKKFKGEHCEIDTSKTCYHGNGQSYRGKANTDTKGRPCLAWNSPAVLQQTYNAHRSDALSLGLGKHNYCRNPDNQRRPWCYVQIGLKQFVQECMVQDCSLSKKPSSTVDQQGFQCGQKALRPRFKIVGGEFTVVENQPWFAAIYLKNKGGSPPSFKCGGSLISPCWVASATHCFVNQPKKEEYVVYLGQSKRNSYNPGEMKFEVEQLILHEDFSDETLAFHNDIALLKIRTSTGQCAQPSRTIQTICLPPRFGDAPFGSDCEITGFGQESATDYFYPKDLKMSVVKIISHEQCKQPHYYGSEINYKMLCAADPEWKTDSCSGDSGGPLICNIDGRPTLSGIVSWGSGCAEKNKPGVYTRVSYFLNWIQSHIGEENGLAF

SEQ ID NO: 54 - protein, 433 aa, Bos taurus
  REGION 1..433: note = u-PA precursor
MRVLLACLLVCALVVSDSDGSNEVHKESGESNCGCLNGGKCVTYKYFSNIQRCSCPKKFQGEHCEIDTSKTCYQGNGHSYRGKANRDLSGRPCLAWDSPTVLLKMYHAHRSDAIQLGLGKHNYCRNPDNQRRPWCYVQIGLKQFVQFCMVQDCSVGKSPSSPREKEEFQCGQKALRPRFKIVGGQVTNAENQPWFAAIYRRHRGGSITYLCGGSLISPCWVVSATHCFIDHPKKENYIVYLGQSRLNSDTRGEMQFEVEKLILHEDYSAESLAHHNDIALLKIRTSRGQCAQPSRSIQTICLPPEHEDAHSRTRCEITGFGKENPSDYRYSDELKMTFVSLVSHEVCQQPHYYGAEVTDKMLCAADPQWETDSCQGDSGGPLVCTIQGRLTLTGIVSWGRDCAMKYKPGVYTRVSKFLPWINTHTRGEINLVL

SEQ ID NO: 55 - protein, 442 aa, Sus scrofa
  REGION 1..442: note = u-PA precursor
MRVLRACLSLCVLVVSDSKGSHELHQESGASNCGCLNGGKCVSYKYFSNIQRCSCPKKFQGEHCEIDTSQTCFEGNGHSYRGKANTNTGGRPCLPWNSATVLLNTYHAHRPDALQLGLGKHNYCRNPDNQRRPWCYVQVGLKQLVQECMVPNCSGGESHRPAYDGKNPFSTPEKVEFQCGQKALRPRFKIVGGKSTTIENQPWFAAIYRRHRGGSVTYVCGGSLISPCWVVSATHCFINYQQKEDYIVYLGRQTLHSSTHGEMKFEVEKLILHEDYSADSLAHHNDIALLKIRTDKGQCAQPSRSIQTICLPPVNGDAHFGASCEIVGFGKEDPSDYLYPEQLKMTVVKLVSHRECQQPHYYGSEVTTKMLCAADPQWKTDSCQGDSGGPLVCSTQGRLTLTGIVSWGRECAMKDKPGVYTRVSRFLTWIHTHVGGENGLAH

SEQ ID NO: 56 - protein, 433 aa, Oryctolagus cuniculus
  REGION 1..433: note = u-PA precursor
MRVLLVCLLLCALVVSDSEGSHELHGVSDASNCGCLNGGTCVTYKYFSNIWRCNCPKKFQGEHCEIDTLKTCYHGDGHSYRGKANTDIMDRPCLAWNSANVLTKTYHAHRPDALQLGLGKHNYCRNPDHQRRPWCYVQVGLKQLIQECKVHDCSSGKKPALPPGKLEFQCGQKALRPRFKIIGGEFTIIENQPWFAAIYRRHRGGSVTYVCGGSLISPCWVVSATHCFINHQKKEDYIVYLGRSRLNSMTPGEMKFEVEQLILHEGYRADTLAHHNDIALLKILSNNGQCAQPSRSIQTICLPPWNADPNFGTSCEITGFGKENSTDYLYPEQLKMTVVKLVSYQECQQPHYYGSEVTTKMLCAADPQWETDSCQGDSGGPLVCSVQGRMTLTGIVSWGRGCALKNKPGVYTRVSRFLPWIRSHIGEENGLAL

SEQ ID NO: 57 - protein, 434 aa, Gallus gallus
  REGION 1..434: note = u-PA precursor
MKLIIFLTVTLCTLVTGLDSVYIRQYYKLSHKHRPQHRECQCLNGGTCITYRFFSQIKRCLCPEGYGGLHCEIDTNSICYSGNGEDYRGMAEDPGCLYWDHPSVIRWGDYHADLKNALQLGLGKHNYCRNPNGRSRPWCYTKRRYSIQETPCSTIEKCERTCGQRSFSKYFKIVGGSQAEVETQPWIAGIFQNIMGTDQFLCGGSLIDPCWVLTAAHCFYNPTKKQPNKSVYKVFLGKSILNTNDEHEQVFMVDEIISHPDFTDHTGGNDNDIALIRIRTASGQCAVESNYVRTVCLPEKNLNLYDNTWCEIAGYGKQNSYDIYYAQRLMSATVNLISQDDCKNKYYDSTRVTDNMVCAGDPLWETDACKGDSGGPMVCEHNGRMTLYGIVSWGDGCAKKNKPGVYTRVTRYLNWIDSNMNAVFTKSRSFREPK

SEQ ID NO: 58 - protein, 433 aa, Papio cynocephalus
  REGION 1..433: note = u-PA precursor
MRALLAHLLLCVLVVSASKGSRELQVPSDCGCLNGGTCMSNKYFSSIHWCNCPKKFGGQHCEIDKSKTCYEGNGHFYRGKASTDTMGRSCLAWNSATVLQQTYHAHRSDALQLGLGKHNYCRNPDNRRRPWCYVQVGLKQRVQECMVHNCADGKKPSSPPEELQFQCGQRTLRPRFKIVGGEFTTIENQPWFAAIYRRHRGGSVTYVCGGSLISPCWVVSATHCFINYPKKEDYIVYLGRSRLNSNTQGEMKFEVENLILHEDYSADTLAHHNDIALLKIRSKEGRCAQPSRTIQTICLPSMYNDPNDPPFGTSCEITGFGKENSTDYLYPEQLKMTVVKLVSHQKCQQPHYYGSEVTTKMLCAADPQWETDSCQGDSGGPLVCSIQGHMTLTGIVSWGRGCALKDKPGVYTRVSRFLPWIHSHTREQNGLAL

SEQ ID NO: 59 - protein, 431 aa, Pongo abelii
  REGION 1..431: note = u-PA precursor
MRALLARLLLCVLVVSDSKGSNELHQVPSNCDCLNGGTCVSNKYFSNIHWCNCPKKFGGQHCEIDKSKTCYEGNGHFYRGKASTDTMGRPCLAWNSATVLQQTYHAHRSDALQLGLGKHNYCRNPDNRWRPWCYVQVGLKPLVQECMVHDCADGKKPSSPPEELKFQCGQKTLRPRFKIVGGEFTTIENQPWFAAIYRRHRGGSVTYVCGGSLISPCWVVSATHCFIDYPKKEDYIVYLGRSRLNSHTQGEMKFEVENLILHKDYSADTLAHHNDIALLKIHSKEGRCAQPSRTIQTICLPSMYNDPPFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSYFLPWIRSHTKEENGLAL

SEQ ID NO: 60 - protein, 428 aa, Canis lupus
  REGION 1..428: note = u-PA precursor
MRALMTCLLLGALVGSHEFHPVSSASNCSCLNGGTCVSYKYFSNIQRCNCPKKFQGEHCEIDTSKTCYEGNGHSYRGKANTNTRGRPCLAWNSAAVLLKQYHALRPDALQLGLGKHNYCRNPDHQRKPWCYVQVGLMQLVQECTVQHCSFEKNPHSPPEKAEFQCGQKALRPRFKIIGGEFTTIENQPWFAAIYRKHRGGSVTYQCGGSLISPCWVVSATHCFINSQKKDDYIVYLGRSKRISKTFGEMKFEVEKLILHEDYSADSLAHHNDIALLKIRSDEGQCAQPSRSIQTICLPPSRGDAHFGASCEISGFGKENSTDYLYPEQLKMTVVKLVSHQECQQPHYYGSEVTDQMLCAADPEWETDSCQGDSGGPLVCSTQGRLTLTGIVSWGSGCAMKNKPGVYTRVSRFLPWIHRHIGEQNGLTL

SEQ ID NO: 61 - protein, 433 aa, Ovis aries
  REGION 1..433: note = u-PA precursor
MRVLLACLLVCALVVSDSDGSNEVHKESGVSDCGCLNGGKCVSYKYFSNIQRCSCPKKFQGEYCEIDTSKTCYQGNGHSYRGKANTDLRGRPRLAWDSATVLLKMYHAHRSDAIQLGLGKHNYCRNPDNQRRPWCYVQVGLKQFVQECMVQDCPAGKGPSSPKEKVEFQCGQKALRPRFEIVGGEFTTIESQPWFAAIYRRHRGGSVTYLCGGSLISPCWVVSATHCFTNHPKKEDYIVYLGRSKLNSDTLGEMKFEVEKLILHEDYSADSLAHHNDIALLKIRTSRGQCAQPSRSIQTICLPPLYGDARFGTRCEITGFGKENPSDYLYPEQLKMTFVNLVSHEECQQPHYYGTEVTDKMLCAADPQWETDSCQGDSGGPLVCTIQGRLTLTGIVSWGRECAMKDKPGVYTRVSKFLPWIYTHTRGEIDLGL

SEQ ID NO: 62 - protein, 430 aa, Callithrix jacchus
  REGION 1..430: note = u-PA
MRTLLVRLLLCVLIVSDSKGRREHQVPSNCDCLNGGTCVSSKYFSNTRWCNCPKKFGGLHCEIDNSKTCYEGNGHFYRGKAKTDIMGRSCLSWNSAAVLQQTYHAHRSDALQLGLGKHNYCRNPDNRRRPWCYVQVGLKQLVQECTVHNCADGKKPSSPPAELEFQCGQKPLTPRFKIIGGEYTTIENQPWFAAIYRQHRGGSVTYLCGGSLISPCWVVSATHCFINHAVKEDFIVYLGRSRLNSNTPGEMRFDVENLILHEGYSADTLAHHNDIALLKIRSKEGKCAQPSRTIQTICLPPMLNDARFGTSCEITGFGKENTTDYFYPEQLKMTVVKLVSHQECQQPNYYGSEVTTKMLCAADPQWETDSCQGDSGGPLICSIQGHMTLTGIVSWGRGCALKDKPGVYTRVSRFLPWIRRHTKEENGPAV

SEQ ID NO: 63 - protein, 430 aa, Macaca mulatta
  REGION 1..430: note = u-PA
MRALLAHLLLCVLVVSDSKGSRELQVPSDCGCLNGGTCMSNKYFSSIHWCNCPKKFGGQHCEIDKSKTCYEGNGHFYRGKASTDTMGRSCLAWNSATVLQQTYHAHRSDALQLGLGKHNYCRNPDNRRRPWCYVQVGLKQLVQECMVQNCADGKKPSSPPEELQFQCGQRTLRPRFKIVGGEFTTIENQPWFAAIYRRHRGGSVTYVCGGSLISPCWVVSATHCFINYPKKEDYIVYLGRSRLNSNTQGEMKFEVENLILHEDYSADTLAHHNDIALLKIRSKEGRCAQPSRTIQTICLPSTYNDPPFGTSCEITGFGKENSTDYLYPERLKMTVVKLVSHQKCQQPHYYGSEVTTKMLCAADPQWETDSCQGDSGGPLVCSIQGHMTLTGIVSWGRGCALKDKPGVYTRVSRFLPWIHSHTREENGLAL

SEQ ID NO: 64 - protein, 345 aa, Nomascus leucogenys
  REGION 1..345: note = u-PA
MGRPCLAWNSATVLQQTYHAHRSDALQLGLGKHNYCRNPDNRRRPWCYVQVGLKPLVQECMVHDCTDGKKPSSPPEELQFQCGQKTLRPRFKIIGGEFTTIENQPWFAAIYRRHRGGSVTYVCGGSLISPCWVVSATHCFIDYPKKEDYIIYLGRSRLNSNTQGEMKFEVENLILHEDYSADTLAHHNDIALLKIRSKEGRCAQPSRTIQTICLPSMYNDPHFGTSCEITGFGKENSTDYLYPEQLKMTVVKLISHKECQQPHYYGSEVTTKMLCAADPQWKTDSCQGDSGGPLVCSIRGRMTLTGIVSWGRGCALKDKPGVYTRVSHFLPWIRSHTKEENGLAL

SEQ ID NO: 65 - protein, 431 aa, Pan troglodytes
  REGION 1..431: note = u-PA
MRAREARLLLCVLVVSDSKGSNELHQVPSNCDCLNGGTCVSNKYFSNIHWCNCPKKFGGQHCEIDKSKTCYEGNGHFYRGKASTDTMGRPCLAWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWFAAIYRRHRGGSVTYLCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 66 - protein, 413 aa, Mus musculus
  REGION 1..413: note = u-PA mature protein
GSVLGAPDESNCGCQNGGVCVSYKYFSRIRRCSCPRKFQGEHCEIDASKTCYHGNGDSYRGKANTDTKGRPCLAWNAPAVLQKPYNAHRPDAISLGLGKHNYCRNPDNQKRPWCYVQIGLRQFVQECMVHDCSLSKKPSSSVDQQGFQCGQKALRPRFKIVGGEFTEVENQPWFAAIYQKNKGGSPPSFKCGGSLISPCWVASAAHCFIQLPKKENYVVYLGQSKESSYNPGEMKFEVEQLILHEYYREDSLAYHNDIALLKIRTSTGQCAQPSRSIQTICLPPRFTDAPFGSDCEITGFGKESESDYLYPKNLKMSVVKLVSHEQCMQPHYYGSEINYKMLCAADPEWKTDSCKGDSGGPLICNIEGRPTLSGIVSWGRGCAEKNKPGVYTRVSHFLDWIQSHIGEEKGLAF

SEQ ID NO: 67 - protein, 413 aa, Rattus norvegicus
  REGION 1..413: note = u-PA mature protein
GSELEASDESNCGCQNGGVCVSYKYFSSIRRCSCPKKFKGEHCEIDTSKTCYHGNGQSYRGKANTDTKGRPCLAWNSPAVLQQTYNAHRSDALSLGLGKHNYCRNPDNQRRPWCYVQIGLKQFVQECMVQDCSLSKKPSSTVDQQGFQCGQKALRPRFKIVGGEFTVVENQPWFAAIYLKNKGGSPPSFKCGGSLISPCWVASATHCFVNQPKKEEYVVYLGQSKRNSYNPGEMKFEVEQLILHEDFSDETLAFHNDIALLKIRTSTGQCAQPSRTIQTICLPPRFGDAPFGSDCEITGFGQESATDYFYPKDLKMSVVKIISHEQCKQPHYYGSEINYKMLCAADPEWKTDSCSGDSGGPLICNIDGRPTLSGIVSWGSGCAEKNKPGVYTRVSYFLNWIQSHIGEENGLAF

SEQ ID NO: 68 - protein, 413 aa, Bos taurus
  REGION 1..413: note = u-PA mature protein
SNEVHKESGESNCGCLNGGKCVTYKYFSNIQRCSCPKKFQGEHCEIDTSKTCYQGNGHSYRGKANRDLSGRPCLAWDSPTVLLKMYHAHRSDAIQLGLGKHNYCRNPDNQRRPWCYVQIGLKQFVQFCMVQDCSVGKSPSSPREKEEFQCGQKALRPRFKIVGGQVTNAENQPWFAAIYRRHRGGSITYLCGGSLISPCWVVSATHCFIDHPKKENYIVYLGQSRLNSDTRGEMQFEVEKLILHEDYSAESLAHHNDIALLKIRTSRGQCAQPSRSIQTICLPPEHEDAHSRTRCEITGFGKENPSDYRYSDELKMTFVSLVSHEVCQQPHYYGAEVTDKMLCAADPQWETDSCQGDSGGPLVCTIQGRLTLTGIVSWGRDCAMKYKPGVYTRVSKFLPWINTHTRGEINLVL

SEQ ID NO: 69 - protein, 422 aa, Sus scrofa
  REGION 1..422: note = u-PA mature protein
SHELHQESGASNCGCLNGGKCVSYKYFSNIQRCSCPKKFQGEHCEIDTSQTCFEGNGHSYRGKANTNTGGRPCLPWNSATVLLNTYHAHRPDALQLGLGKHNYCRNPDNQRRPWCYVQVGLKQLVQECMVPNCSGGESHRPAYDGKNPFSTPEKVEFQCGQKALRPRFKIVGGKSTTIENQPWFAAIYRRHRGGSVTYVCGGSLISPCWVVSATHCFINYQQKEDYIVYLGRQTLHSSTHGEMKFEVEKLILHEDYSADSLAHHNDIALLKIRTDKGQCAQPSRSIQTICLPPVNGDAHFGASCEIVGFGKEDPSDYLYPEQLKMTVVKLVSHRECQQPHYYGSEVTTKMLCAADPQWKTDSCQGDSGGPLVCSTQGRLTLTGIVSWGRECAMKDKPGVYTRVSRFLTWIHTHVGGENGLAH

SEQ ID NO: 70 - protein, 417 aa, Oryctolagus cuniculus
  REGION 1..417: note = u-PA mature protein
DSEGSHELHGVSDASNCGCLNGGTCVTYKYFSNIWRCNCPKKFQGEHCEIDTLKTCYHGDGHSYRGKANTDIMDRPCLAWNSANVLTKTYHAHRPDALQLGLGKHNYCRNPDHQRRPWCYVQVGLKQLIQECKVHDCSSGKKPALPPGKLEFQCGQKALRPRFKIIGGEFTIIENQPWFAAIYRRHRGGSVTYVCGGSLISPCWVVSATHCFINHQKKEDYIVYLGRSRLNSMTPGEMKFEVEQLILHEGYRADTLAHHNDIALLKILSNNGQCAQPSRSIQTICLPPWNADPNFGTSCEITGFGKENSTDYLYPEQLKMTVVKLVSYQECQQPHYYGSEVTTKMLCAADPQWETDSCQGDSGGPLVCSVQGRMTLTGIVSWGRGCALKNKPGVYTRVSRFLPWIRSHIGEENGLAL

SEQ ID NO: 71 - protein, 414 aa, Gallus gallus
  REGION 1..414: note = u-PA mature protein
VYIRQYYKLSHKHRPQHRECQCLNGGTCITYRFFSQIKRCLCPEGYGGLHCEIDTNSICYSGNGEDYRGMAEDPGCLYWDHPSVIRWGDYHADLKNALQLGLGKHNYCRNPNGRSRPWCYTKRRYSIQETPCSTIEKCERTCGQRSFSKYFKIVGGSQAEVETQPWIAGIFQNIMGTDQFLCGGSLIDPCWVLTAAHCFYNPTKKQPNKSVYKVFLGKSILNTNDEHEQVFMVDEIISHPDFTDHTGGNDNDIALIRIRTASGQCAVESNYVRTVCLPEKNLNLYDNTWCEIAGYGKQNSYDIYYAQRLMSATVNLISQDDCKNKYYDSTRVTDNMVCAGDPLWETDACKGDSGGPMVCEHNGRMTLYGIVSWGDGCAKKNKPGVYTRVTRYLNWIDSNMNAVFTKSRSFREPK

SEQ ID NO: 72 - protein, 413 aa, Papio cynocephalus
  REGION 1..413: note = u-PA mature protein
SRELQVPSDCGCLNGGTCMSNKYFSSIHWCNCPKKFGGQHCEIDKSKTCYEGNGHFYRGKASTDTMGRSCLAWNSATVLQQTYHAHRSDALQLGLGKHNYCRNPDNRRRPWCYVQVGLKQRVQECMVHNCADGKKPSSPPEELQFQCGQRTLRPRFKIVGGEFTTIENQPWFAAIYRRHRGGSVTYVCGGSLISPCWVVSATHCFINYPKKEDYIVYLGRSRLNSNTQGEMKFEVENLILHEDYSADTLAHHNDIALLKIRSKEGRCAQPSRTIQTICLPSMYNDPNDPPFGTSCEITGFGKENSTDYLYPEQLKMTVVKLVSHQKCQQPHYYGSEVTTKMLCAADPQWETDSCQGDSGGPLVCSIQGHMTLTGIVSWGRGCALKDKPGVYTRVSRFLPWIHSHTREQNGLAL

SEQ ID NO: 73 - protein, 411 aa, Pongo abelii
  REGION 1..411: note = u-PA mature protein
SNELHQVPSNCDCLNGGTCVSNKYFSNIHWCNCPKKFGGQHCEIDKSKTCYEGNGHFYRGKASTDTMGRPCLAWNSATVLQQTYHAHRSDALQLGLGKHNYCRNPDNRWRPWCYVQVGLKPLVQECMVHDCADGKKPSSPPEELKFQCGQKTLRPRFKIVGGEFTTIENQPWFAAIYRRHRGGSVTYVCGGSLISPCWVVSATHCFIDYPKKEDYIVYLGRSRLNSHTQGEMKFEVENLILHKDYSADTLAHHNDIALLKIHSKEGRCAQPSRTIQTICLPSMYNDPPFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSYFLPWIRSHTKEENGLAL

SEQ ID NO: 74 - protein, 404 aa, Canis lupus
  REGION 1..404: note = u-PA mature protein
ASNCSCLNGGTCVSYKYFSNIQRCNCPKKFQGEHCEIDTSKTCYEGNGHSYRGKANTNTRGRPCLAWNSAAVLLKQYHALRPDALQLGLGKHNYCRNPDHQRKPWCYVQVGLMQLVQECTVQHCSFEKNPHSPPEKAEFQCGQKALRPRFKIIGGEFTTIENQPWFAAIYRKHRGGSVTYQCGGSLISPCWVVSATHCFINSQKKDDYIVYLGRSKRISKTFGEMKFEVEKLILHEDYSADSLAHHNDIALLKIRSDEGQCAQPSRSIQTICLPPSRGDAHFGASCEISGFGKENSTDYLYPEQLKMTVVKLVSHQECQQPHYYGSEVTDQMLCAADPEWETDSCQGDSGGPLVCSTQGRLTLTGIVSWGSGCAMKNKPGVYTRVSRFLPWIHRHIGEQNGLTL

SEQ ID NO: 75 - protein, 413 aa, Ovis aries
  REGION 1..413: note = u-PA mature protein
SNEVHKESGVSDCGCLNGGKCVSYKYFSNIQRCSCPKKFQGEYCEIDTSKTCYQGNGHSYRGKANTDLRGRPRLAWDSATVLLKMYHAHRSDAIQLGLGKHNYCRNPDNQRRPWCYVQVGLKQFVQECMVQDCPAGKGPSSPKEKVEFQCGQKALRPRFEIVGGEFTTIESQPWFAAIYRRHRGGSVTYLCGGSLISPCWVVSATHCFTNHPKKEDYIVYLGRSKLNSDTLGEMKFEVEKLILHEDYSADSLAHHNDIALLKIRTSRGQCAQPSRSIQTICLPPLYGDARFGTRCEITGFGKENPSDYLYPEQLKMTFVNLVSHEECQQPHYYGTEVTDKMLCAADPQWETDSCQGDSGGPLVCTIQGRLTLTGIVSWGRECAMKDKPGVYTRVSKFLPWIYTHTRGEIDLGL

SEQ ID NO: 76 - protein, 263 aa, synthetic construct
  REGION 1..263: note = mature chymotrypsin polypeptide
MAFLWLLSCWALLGTTFGCGVPAIHPVLSGLSRIVNGEDAVPGSWPWQVSLQDKTGFHFCGGSLISEDWVVTAAHCGVRTSDVVVAGEFDQGSDEENIQVLKIAKVFKNPKFSILTVNNDITLLKLATPARFSQTVSAVCLPSADDDFPAGTLCATTGWGKTKYNANKTPDKLQQAALPLLSNAECKKSWGRRITDVMICAGASGVSSCMGDSGGPLVCQKDGAWTLVGIVSWGSDTCSTSSPGVYARVTKLIPWVQKILAAN

SEQ ID NO: 77 - protein, 1636 aa, synthetic construct
  REGION 1..1636: note = mature 2 chain C3 protein
PMYSIITPNILRLESEETMVLEAHDAQGDVPVTVTVHDFPGKKLVLSSEKTVLTPATNHMGNVTFTIPANREFKSEKGRNKFVTVQATFGTQVVEKVVLVSLQSGYLFIQTDKTIYTPGSTVLYRIFTVNHKLLPVGRTVMVNIENPEGIPVKQDSLSSQNQLGVLPLSWDIPELVNMGQWKIRAYYENSPQQVFSTEFEVKEYVLPSFEVIVEPTEKFYYIYNEKGLEVTITARFLYGKKVEGTAFVIFGIQDGEQRISLPESLKRIPIEDGSGEVVLSRKVLLDGVQNPRAEDLVGKSLYVSATVILHSGSDMVQAERSGIPIVTSPYQIHFTKTPKYFKPGMPFDLMVFVTNPDGSPAYRVPVAVQGEDTVQSLTQGDGVAKLSINTHPSQKPLSITVRTKKQELSEAEQATRTMQALPYSTVGNSNNYLHLSVLRTELRPGETLNVNFLLRMDRAHEAKIRYYTYLIMNKGRLLKAGRQVREPGQDLVVLPLSITTDFIPSFRLVAYYTLIGASGQREVVADSVWVDVKDSCVGSLVVKSGQSEDRQPVPGQQMTLKIEGDHGARVVLVAVDKGVFVLNKKNKLTQSKIWDVVEKADIGCTPGSGKDYAGVFSDAGLTFTSSSGQQTAQRAELQCPQPAASVQLTEKRMDKVGKYPKELRKCCEDGMRENPMRFSCQRRTRFISLGEACKKVFLDCCNYITELRRQHARASHLGLARSNLDEDIIAEENIVSRSEFPESWLWNVEDLKEPPKNGISTKLMNIFLKDSITTWEILAVSMSDKKGICVADPFEVTVMQDFFIDLRLPYSVVRNEQVEIRAVLYNYRQNQELKVRVELLHNPAFCSLATTKRRHQQTVTIPPKSSLSVPYVIVPLKTGLQEVEVKAAVYHHFISDGVRKSLKVVPEGIRMNKTVAVRTLDPERLGREGVQKEDIPPADLSDQVPDTESETRILLQGTPVAQMTEDAVDAERLKHLIVTPSGCGEQNMIGMTPTVIAVHYLDETEQWEKFGLEKRQGALELIKKGYTQQLAFRQPSSAFAAFVKRAPSTWLTAYVVKVFSLAVNLIAIDSQVLCGAVKWLILEKQKPDGVFQEDAPVIHQEMIGGLRNNNEKDMALTAFVLISLQEAKDICEEQVNSLPGSITKAGDFLEANYMNLQRSYTVAIAGYALAQMGRLKGPLLNKFLTTAKDKNRWEDPGKQLYNVEATSYALLALLQLKDFDFVPPVVRWLNEQRYYGGGYGSTQATFMVFQALAQYQKDAPDHQELNLDVSLQLPSRSSKITHRIHWESASLLRSEETKENEGFTVTAEGKGQGTLSVVTMYHAKAKDQLTCNKFDLKVTIKPAPETEKRPQDAKNTMILEICTRYRGDQDATMSILDISMMTGFAPDTDDLKQLANGVDRYISKYELDKAFSDRNTLIIYLDKVSHSEDDCLAFKVHQYFNVELIQPGAVKVYAYYNLEESCTRFYHPEKEDGKLNKLCRDELCRCAEENCFIQKSDDKVTLEERLDKACEPGVDYVYKTRLVKVQLSNDFDEYIMAIEQTIKSGSDEVQVGQQRTFISPIKCREALKLEEKKHYLMWGLSSDFWGEKPNLSYIIGKDTWVEHWPEEDECQDEENQKQCQDLGAFTESMVVFGCPN

SEQ ID NO: 78 - protein, 4 aa, synthetic construct
  REGION 1..4: note = C3 convertase cleavage site 748-749
GLAR

SEQ ID NO: 79 - protein, 4 aa, synthetic construct
  REGION 1..4: note = Factor I cleavage site 954-955
RLGR

SEQ ID NO: 80 - protein, 4 aa, synthetic construct
  REGION 1..4: note = Factor I cleavage site 1303-1304
LPSR

SEQ ID NO: 81 - protein, 4 aa, synthetic construct
  REGION 1..4: note = Factor I cleavage site 1320-1321
SLLR

SEQ ID NO: 82 - protein, 21 aa, synthetic construct
  REGION 1..21: note = Buforin II
TRSSRAGLQFPVGRVHRLLRK

SEQ ID NO: 83 - protein, 16 aa, synthetic construct
  REGION 1..16: note = DPV3
RKKRRRESRKKRRRES

SEQ ID NO: 84 - protein, 17 aa, synthetic construct
  REGION 1..17: note = DPV6
GRPRESGKKRKRKRLKP

SEQ ID NO: 85 - protein, 15 aa, synthetic construct
  REGION 1..15: note = DPV7
GKRKKKGKLGKKRDP

SEQ ID NO: 86 - protein, 17 aa, synthetic construct
  REGION 1..17: note = DPV7b
GKRKKKGKLGKKRPRSR

SEQ ID NO: 87 - protein, 18 aa, synthetic construct
  REGION 1..18: note = DPV3/10
RKKRRRESRRARRSPRHL

SEQ ID NO: 88 - protein, 19 aa, synthetic construct
  REGION 1..19: note = DPV10/6
SRRARRSPRESGKKRKRKR

SEQ ID NO: 89 - protein, 19 aa, synthetic construct
  REGION 1..19: note = DPV1047
VKRGLKLRHVRPRVTRMDV

SEQ ID NO: 90 - protein, 18 aa, synthetic construct
  REGION 1..18: note = DPV1048
VKRGLKLRHVRPRVTRDV

SEQ ID NO: 91 - protein, 14 aa, synthetic construct
  REGION 1..14: note = DPV10
SRRARRSPRHLGSG

SEQ ID NO: 92 - protein, 16 aa, synthetic construct
  REGION 1..16: note = DPV15
LRRERQSRLRRERQSR

SEQ ID NO: 93 - protein, 22 aa, synthetic construct
  REGION 1..22: note = DPV15b
GAYDLRRRERQSRLRRRERQSR

SEQ ID NO: 94 - protein, 30 aa, synthetic construct
  REGION 1..30: note = GALA
WEAALAEALAEALAEHLAEALAEALEALAA

SEQ ID NO: 95 - protein, 21 aa, synthetic construct
  REGION 1..21: note = Fibrinogen beta chain
KGSWYSMRKMSMKIRPFFPQQ

SEQ ID NO: 96 - protein, 20 aa, synthetic construct
  REGION 1..20: note = Fibrinogen gamma chain precursor
KTRYYSMKKTTMKIIPFNRL

SEQ ID NO: 97 - protein, 20 aa, synthetic construct
  REGION 1..20: note = Fibrinogen alpha chain
RGADYSLRAVRMKIRPLVTQ

SEQ ID NO: 98 - protein, 24 aa, synthetic construct
  REGION 1..24: note = hCT(9-32)
LGTYTQDFNKFHTFPQTAIGVGAP

SEQ ID NO: 99 - protein, 12 aa, synthetic construct
  REGION 1..12: note = HN-1
TSPLNIHNGQKL

SEQ ID NO: 100 - protein, 12 aa, synthetic construct
  REGION 1..12: note = Influenza virus nucleoprotein (NLS)
NSAAFEDLRVLS

SEQ ID NO: 101 - protein, 30 aa, synthetic construct
  REGION 1..30: note = KALA
WEAKLAKALAKALAKHLAKALAKALKACEA

SEQ ID NO: 102 - protein, 10 aa, synthetic construct
  REGION 1..10: note = Ku70
VPMLKPMLKE

SEQ ID NO: 103 - protein, 18 aa, synthetic construct
  REGION 1..18: note = MAP
KLALKLALKALKAALKLA

SEQ ID NO: 104 - protein, 27 aa, synthetic construct
  REGION 1..27: note = MPG
GALFLGFLGAAGSTMGAWSQPKKKRKV

SEQ ID NO: 105 - protein, 16 aa, synthetic construct
  REGION 1..16: note = Human Fibroblast growth factor 4 (Kaposi Fibroblast growth factor)
AAVALLPAVLLALLAP

SEQ ID NO: 106 - protein, 9 aa, synthetic construct
  REGION 1..9: note = N50 (NLS of NF-kB P50)
VQRKRQKLM

SEQ ID NO: 107 - protein, 21 aa, synthetic construct
  REGION 1..21: note = Pep-1
KETWWETWWTEWSQPKKKRKV

SEQ ID NO: 108 - protein, 15 aa, synthetic construct
  REGION 1..15: note = Pep-7
SDLWEMMMVSLACQY

SEQ ID NO: 109 - protein, 16 aa, synthetic construct
  REGION 1..16: note = Penetratin
RQIKIWFQNRRMKWKK

SEQ ID NO: 110 - protein, 17 aa, synthetic construct
  REGION 1..17: note = Penetratin variant
GRQIKIWFQNRRMKWKK

SEQ ID NO: 111 - protein, 7 aa, synthetic construct
  REGION 1..7: note = Short Penetratin
RRMKWKK

SEQ ID NO: 112 - protein, 17 aa, synthetic construct
  REGION 1..17: note = Penetratin 42-58
ERQIKIWFQNRRMKWKK

SEQ ID NO: 113 - protein, 7 aa, synthetic construct
  REGION 1..7: note = Poly Arginine - R7
RRRRRRR

SEQ ID NO: 114 - protein, 9 aa, synthetic construct
  REGION 1..9: note = Poly Arginine - R9
RRRRRRRRR

SEQ ID NO: 115 - protein, 16 aa, synthetic construct
  REGION 1..16: note = pISL
RVIRVWFQNKRCKDKK

SEQ ID NO: 116 - protein, 28 aa, synthetic construct
  REGION 1..28: note = Prion mouse PrPc1-28
MANLGYWLLALFVTMWTDVGLCKKRPKP

SEQ ID NO: 117 - protein, 18 aa, synthetic construct
  REGION 1..18: note = pVEC
LLIILRRRIRKQAHAHSK

SEQ ID NO: 118 - protein, 16 aa, synthetic construct
  REGION 1..16: note = pVEC variant
LLIILRRRIRKQAHAH

SEQ ID NO: 119 - protein, 18 aa, synthetic construct
  REGION 1..18: note = SAP
VRLPPPVRLPPPVRLPPP

SEQ ID NO: 120 - protein, 7 aa, synthetic construct
  REGION 1..7: note = SV-40 (NLS)
PKKKRKV

SEQ ID NO: 121 - protein, 18 aa, synthetic construct
  REGION 1..18: note = SynB1
RGGRLSYSRRRFSTSTGR

SEQ ID NO: 122 - protein, 10 aa, synthetic construct
  REGION 1..10: note = SynB3
RRLSYSRRRF

SEQ ID NO: 123 - protein, 17 aa, synthetic construct
  REGION 1..17: note = SynB4
AWSFRVSYRGISYRRSR

SEQ ID NO: 124 - protein, 14 aa, synthetic construct
  REGION 1..14: note = Tat 47-60
YGRKKRRQRRRPPQ

SEQ ID NO: 125 - protein, 11 aa, synthetic construct
  REGION 1..11: note = Tat 47-57
YGRKKRRQRRR

SEQ ID NO: 126 - protein, 10 aa, synthetic construct
  REGION 1..10: note = Tat 47-56
YGRKKRRQRR

SEQ ID NO: 127 - protein, 9 aa, synthetic construct
  REGION 1..9: note = Tat 48-56
GRKKRRQRR

SEQ ID NO: 128 - protein, 10 aa, synthetic construct
  REGION 1..10: note = Tat 48-57
GRKKRRQRRR

SEQ ID NO: 129 - protein, 9 aa, synthetic construct
  REGION 1..9: note = Tat 49-57
RKKRRQRRR

SEQ ID NO: 130 - protein, 8 aa, synthetic construct
  REGION 1..8: note = Tat 49-56
RKKRRQRR

SEQ ID NO: 131 - protein, 13 aa, synthetic construct
  REGION 1..13: note = Tat 48-60
GRKKRRQRRRPPQ

SEQ ID NO: 132 - protein, 5 aa, synthetic construct
  REGION 1..5: note = Tat 48-52
GRKKR

SEQ ID NO: 133 - protein, 36 aa, synthetic construct
  REGION 1..36: note = Tat 37-72
CFITKALGISYGRKKRRQRRRPPQFSQTHQVSLSKQ

SEQ ID NO: 134 - protein, 35 aa, synthetic construct
  REGION 1..35: note = Tat 38-72
FITKALGISYGRKKRRQRRRPPQFSQTHQVSLSKQ

SEQ ID NO: 135 - protein, 13 aa, synthetic construct
  REGION 1..13: note = Tat 47-59
YGRKKRRQRRRPP

SEQ ID NO: 136 - protein, 27 aa, synthetic construct
  REGION 1..27: note = Transportan
GWTLNSAGYLLGKINLKALAALAKKIL

SEQ ID NO: 137 - protein, 21 aa, synthetic construct
  REGION 1..21: note = Transportan 10
AGYLLGKINLKALAALAKKIL

SEQ ID NO: 138 - protein, 12 aa, synthetic construct
  REGION 1..12: note = Transportan derivative
GWTLNSAGYLLG

SEQ ID NO: 139 - protein, 14 aa, synthetic construct
  REGION 1..14: note = Transportan derivative
INLKALAALAKKIL

SEQ ID NO: 140 - protein, 34 aa, synthetic construct
  REGION 1..34: note = VP22
DAATATRGRSAASRPTERPRAPARSASRPRRPVD

SEQ ID NO: 141 - protein, 26 aa, synthetic construct
  REGION 1..26: note = VT5
DPKGDPKGVTVTVTVTVTGKGDPKPD

SEQ ID NO: 142 - protein, 27 aa, synthetic construct
  REGION 1..27: note = Signal Sequence-based peptide
GALFLGWLGAAGSTMGAWSQPKKKRKV

SEQ ID NO: 143 - protein, 18 aa, synthetic construct
  REGION 1..18: note = Amphiphilic model peptide
KLALKLALKALKAALKLA

SEQ ID NO: 144 - protein, 10 aa, synthetic construct
  REGION 1..10: note = Bacterial cell wall permeating
KFFKFFKFFK

SEQ ID NO: 145 - protein, 37 aa, synthetic construct
  REGION 1..37: note = LL- 37
LLGDFFRKSKEKIGKEFKRIVQRIKDFLRNLVPRTES

SEQ ID NO: 146 - protein, 31 aa, synthetic construct
  REGION 1..31: note = Cecropin P1
SWLSKTAKKLENSAKKRISEGIAIAIQGGPR

SEQ ID NO: 147 - protein, 30 aa, synthetic construct
  REGION 1..30: note = alpha defensin
ACYCRIPACIAGERRYGTCIYQGRLWAFCC

SEQ ID NO: 148 - protein, 36 aa, synthetic construct
  REGION 1..36: note = beta defensin
DHYNCVSSGGQCLYSACPIFTKIQGTCYRGKAKCCK

SEQ ID NO: 149 - protein, 11 aa, synthetic construct
  REGION 1..11: note = Bactenecin
RKCRIWIRVCR

SEQ ID NO: 150 - protein, 42 aa, synthetic construct
  REGION 1..42: note = PR- 39
RRRPRPPYLPRPRPPPFFPPRLPPRIPPGFPPRFPPRFPGKR

SEQ ID NO: 151 - protein, 13 aa, synthetic construct
  REGION 1..13: note = Indolicidin
ILPWKWPWWPWRR

SEQ ID NO: 152 - protein, 27 aa, synthetic construct
  REGION 1..27: note = MPS
GALFLGWLGAAGSTMGAWSQPKKKRKV

SEQ ID NO: 153 - protein, 17 aa, synthetic construct
  REGION 1..17: note = pIs1
PVIRRVWFQNKRCKDKK

SEQ ID NO: 154 - protein, 251 aa, synthetic construct
  REGION 1..251: note = UROKINASE-TYPE PLASMINOGEN ACTIVATOR (u-PA) protease domain V38D/T97adel/L97bdel/C122S
IIGGEFTTIENQPWFAAIYRRHRGGSDTYVCGGSLISPCWVISATHCFIDYPKKEDYIVYLGRSRLNSNTQGEMKFEVENLILHKDYSADAHHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 155 - protein, 253 aa, synthetic construct
  REGION 1..253: note = UROKINASE-TYPE PLASMINOGEN ACTIVATOR (u-PA) protease domain L73R/L97bG/H99Q/C122S
IIGGEFTTIENQPWFAAIYRRHRGGSVTYVCGGSLISPCWVISATHCFIDYPKKEDYIVYLGRSRRNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 156 - protein, 253 aa, synthetic construct
  REGION 1..253: note = UROKINASE-TYPE PLASMINOGEN ACTIVATOR (u-PA) protease domain V38D/L73R/L97bG/H99Q/C122S
IIGGEFTTIENQPWFAAIYRRHRGGSDTYVCGGSLISPCWVISATHCFIDYPKKEDYIVYLGRSRRNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 157 - protein, 253 aa, synthetic construct
  REGION 1..253: note = UROKINASE-TYPE PLASMINOGEN ACTIVATOR (u-PA) protease domain L97bP/H99L/C122S
IIGGEFTTIENQPWFAAIYRRHRGGSVTYVCGGSLISPCWVISATHCFIDYPKKEDYIVYLGRSRLNSNTQGEMKFEVENLILHKDYSADTPALHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 158 - protein, 252 aa, synthetic construct
  REGION 1..252: note = UROKINASE-TYPE PLASMINOGEN ACTIVATOR (u-PA) protease domain R37aP/V38D/V41R/A96D/D97G/T97aN/A98G/L97bdel/H99L/ C122S/M157K/R217F
IIGGEFTTIENQPWFAAIYRRHPGGSDTYRCGGSLISPCWVISATHCFIDYPKKEDYIVYLGRSRLNSNTQGEMKFEVENLILHKDYSDGNGLHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGFGCALKDKPGVYTRVSHFLPWIRSHTKEENGLAL

SEQ ID NO: 159 - protein, 252 aa, synthetic construct
  REGION 1..252: note = UROKINASE-TYPE PLASMINOGEN ACTIVATOR (u-PA) protease domain R37aS/G37bD/V38D/V41R/A96D/D97G/T97aN/A98G/L97bdel /H99L/C122S/R217F
IIGGEFTTIENQPWFAAIYRRHSDGSDTYRCGGSLISPCWVISATHCFIDYPKKEDYIVYLGRSRLNSNTQGEMKFEVENLILHKDYSDGNGLHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGFGCALKDKPGVYTRVSHFLPWIRSHTKEENGLAL

SEQ ID NO: 160 - protein, 251 aa, synthetic construct
  REGION 1..251: note = UROKINASE-TYPE PLASMINOGEN ACTIVATOR (u-PA) protease domain R36H/V38D/V41R/A96D/D97G/A98R/T97adel/H99L/L97bdel /C122S/M157K/R217D
IIGGEFTTIENQPWFAAIYRHHRGGSDTYRCGGSLISPCWVISATHCFIDYPKKEDYIVYLGRSRLNSNTQGEMKFEVENLILHKDYSDGRLHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGDGCALKDKPGVYTRVSHFLPWIRSHTKEENGLAL

SEQ ID NO: 161 - protein, 251 aa, synthetic construct
  REGION 1..251: note = UROKINASE-TYPE PLASMINOGEN ACTIVATOR (u-PA) protease domain R37aH/V38D/V41R/A96D/D97G/A98G/T97adel/H99L/L97bde l/C122S/S174P/R217D
IIGGEFTTIENQPWFAAIYRRHHGGSDTYRCGGSLISPCWVISATHCFIDYPKKEDYIVYLGRSRLNSNTQGEMKFEVENLILHKDYSDGGLHNDIALLKIRSKEGRCAQPSRTIQTISLPSMYNDPQFGTSCEITGFGKENSTDYLYPEQLKMTVVKLISHRECQQPHYYGPEVTTKMLCAADPQWKTDSCQGDSGGPLVCSLQGRMTLTGIVSWGDGCALKDKPGVYTRVSHFLPWIRSHTKEENGLAL

SEQ ID NO: 162 - protein, 252 aa, synthetic construct
  REGION 1..252: note = UROKINASE-TYPE PLASMINOGEN ACTIVATOR (u-PA) protease domain R37aH/V38D/V41G/A96G/D97E/T97aA/A98G/L97bdel/H99M/ C122S/Y151N
IIGGEFTTIENQPWFAAIYRRHHGGSDTYGCGGSLISPCWVISATHCFIDYPKKEDYIVYLGRSRLNSNTQGEMKFEVENLILHKDYSGEAGMHNDIALLKIRSKEGRCAQPSRTIQTISLPSMYNDPQFGTSCEITGFGKENSTDYLNPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 163 - protein, 252 aa, synthetic construct
  REGION 1..252: note = UROKINASE-TYPE PLASMINOGEN ACTIVATOR (u-PA) protease domain R36S/V38D/Y40L/V41R/A96P/D97V/T97aR/A98G/L97bdel/H 99L/C122S
IIGGEFTTIENQPWFAAIYRSHRGGSDTLRCGGSLISPCWVISATHCFIDYPKKEDYIVYLGRSRLNSNTQGEMKFEVENLILHKDYSPVRGLHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 164 - protein, 251 aa, synthetic construct
  REGION 1..251: note = UROKINASE-TYPE PLASMINOGEN ACTIVATOR (u-PA) protease domain R36S/V38D/V41R/A96D/D97G/A98G/T97adel/H99L/L97bdel /C122S/M157K/R217D
IIGGEFTTIENQPWFAAIYRSHRGGSDTYRCGGSLISPCWVISATHCFIDYPKKEDYIVYLGRSRLNSNTQGEMKFEVENLILHKDYSDGGLHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGDGCALKDKPGVYTRVSHFLPWIRSHTKEENGLAL

SEQ ID NO: 165 - protein, 251 aa, synthetic construct
  REGION 1..251: note = UROKINASE-TYPE PLASMINOGEN ACTIVATOR (u-PA) protease domain V38D/V41R/A96D/D97G/A98G/T97adel/H99L/L97bdel/C122 S/Q192E/R217D
IIGGEFTTIENQPWFAAIYRRHRGGSDTYRCGGSLISPCWVISATHCFIDYPKKEDYIVYLGRSRLNSNTQGEMKFEVENLILHKDYSDGGLHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCEGDSGGPLVCSLQGRMTLTGIVSWGDGCALKDKPGVYTRVSHFLPWIRSHTKEENGLAL

SEQ ID NO: 166 - protein, 251 aa, synthetic construct
  REGION 1..251: note = UROKINASE-TYPE PLASMINOGEN ACTIVATOR (u-PA) protease domain F30Y/V38D/V41R/A96D/D97G/A98G/T97adel/H99L/L97bdel /C122S/M157K/R217D
IIGGEFTTIENQPWYAAIYRRHRGGSDTYRCGGSLISPCWVISATHCFIDYPKKEDYIVYLGRSRLNSNTQGEMKFEVENLILHKDYSDGGLHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGDGCALKDKPGVYTRVSHFLPWIRSHTKEENGLAL

SEQ ID NO: 167 - protein, 253 aa, synthetic construct
  REGION 1..253: note = UROKINASE-TYPE PLASMINOGEN ACTIVATOR (u-PA) protease domain V38D/Y40P/V41K/L97bA/H99Q/C122S
IIGGEFTTIENQPWFAAIYRRHRGGSDTPKCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 168 - protein, 253 aa, synthetic construct
  REGION 1..253: note = UROKINASE-TYPE PLASMINOGEN ACTIVATOR (u-PA) protease domain V38D/Y40P/V41K/L97bA/H99Q/C122S/M157K
IIGGEFTTIENQPWFAAIYRRHRGGSDTPKCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 169 - protein, 251 aa, synthetic construct
  REGION 1..251: note = UROKINASE-TYPE PLASMINOGEN ACTIVATOR (u-PA) protease domain V38D/V41R/A96E/D97G/A98G/T97adel/H99L/L97bdel/C122 S/Y151L/T178S/Q192E/R217D
IIGGEFTTIENQPWFAAIYRRHRGGSDTYRCGGSLISPCWVISATHCFIDYPKKEDYIVYLGRSRLNSNTQGEMKFEVENLILHKDYSEGGLHNDIALLKIRSKEGRCAQPSRTIQTISLPSMYNDPQFGTSCEITGFGKENSTDYLLPEQLKMTVVKLISHRECQQPHYYGSEVTSKMLCAADPQWKTDSCEGDSGGPLVCSLQGRMTLTGIVSWGDGCALKDKPGVYTRVSHFLPWIRSHTKEENGLAL

SEQ ID NO: 170 - protein, 253 aa, synthetic construct
  REGION 1..253: note = UROKINASE-TYPE PLASMINOGEN ACTIVATOR (u-PA) protease domain F30Y/V38D/Y40H/V41R/L97bA/H99Q/C122S/M157K/R217D
IIGGEFTTIENQPWYAAIYRRHRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGDGCALKDKPGVYTRVSHFLPWIRSHTKEENGLAL

SEQ ID NO: 171 - protein, 253 aa, synthetic construct
  REGION 1..253: note = UROKINASE-TYPE PLASMINOGEN ACTIVATOR (u-PA) protease domain F30H/V38D/V41R/L97bA/H99Q/Y151L/M157K
IIGGEFTTIENQPWHAAIYRRHRGGSDTYRCGGSLISPCWVISATHCFIDYPKKEDYIVYLGRSRLNSNTQGEMKFEVENLILHKDYSADTAAQHNDIALLKIRSKEGRCAQPSRTIQTICLPSMYNDPQFGTSCEITGFGKENSTDYLLPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 172 - protein, 253 aa, synthetic construct
  REGION 1..253: note = UROKINASE-TYPE PLASMINOGEN ACTIVATOR (u-PA) protease domain F30Y/V38D/V41R/L97bV/H99Q/C122S/Y151F/M157K
IIGGEFTTIENQPWYAAIYRRHRGGSDTYRCGGSLISPCWVISATHCFIDYPKKEDYIVYLGRSRLNSNTQGEMKFEVENLILHKDYSADTVAQHNDIALLKIRSKEGRCAQPSRTIQTISLPSMYNDPQFGTSCEITGFGKENSTDYLFPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 173 - protein, 253 aa, synthetic construct
  REGION 1..253: note = UROKINASE-TYPE PLASMINOGEN ACTIVATOR (u-PA) protease domain F30H/V38D/V41R/L97bV/H99Q/C122S/Y151L/M157K
IIGGEFTTIENQPWHAAIYRRHRGGSDTYRCGGSLISPCWVISATHCFIDYPKKEDYIVYLGRSRLNSNTQGEMKFEVENLILHKDYSADTVAQHNDIALLKIRSKEGRCAQPSRTIQTISLPSMYNDPQFGTSCEITGFGKENSTDYLLPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 174 - protein, 253 aa, synthetic construct
  REGION 1..253: note = UROKINASE-TYPE PLASMINOGEN ACTIVATOR (u-PA) protease domain F30H/V38D/V41R/L97bA/H99Q/C122S/Y151F/M157K
IIGGEFTTIENQPWHAAIYRRHRGGSDTYRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLFPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 175 - protein, 253 aa, synthetic construct
  REGION 1..253: note = UROKINASE-TYPE PLASMINOGEN ACTIVATOR (u-PA) protease domain F30H/V38D/V41R/L97bA/H99Q/C122S/Y151M/M157K
IIGGEFTTIENQPWHAAIYRRHRGGSDTYRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLMPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 176 - protein, 253 aa, synthetic construct
  REGION 1..253: note = UROKINASE-TYPE PLASMINOGEN ACTIVATOR (u-PA) protease domain F30H/V38D/V41R/L97bA/H99Q/C122S/Y149N/Y151L/M157K
IIGGEFTTIENQPWHAAIYRRHRGGSDTYRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDNLLPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 177 - protein, 253 aa, synthetic construct
  REGION 1..253: note = UROKINASE-TYPE PLASMINOGEN ACTIVATOR (u-PA) protease domain F30H/V38D/V41R/L97bA/H99Q/C122S/Y149N/Y151F/M157K
IIGGEFTTIENQPWHAAIYRRHRGGSDTYRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDNLFPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 178 - protein, 253 aa, synthetic construct
  REGION 1..253: note = UROKINASE-TYPE PLASMINOGEN ACTIVATOR (u-PA) protease domain F30Y/V38D/V41R/L97bV/H99Q/C122S/M157K
IIGGEFTTIENQPWYAAIYRRHRGGSDTYRCGGSLISPCWVISATHCFIDYPKKEDYIVYLGRSRLNSNTQGEMKFEVENLILHKDYSADTVAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 179 - protein, 253 aa, synthetic construct
  REGION 1..253: note = UROKINASE-TYPE PLASMINOGEN ACTIVATOR (u-PA) protease domain F30H/V38D/V41R/L97bV/H99Q/C122S/Y151F/M157K
IIGGEFTTIENQPWHAAIYRRHRGGSDTYRCGGSLISPCWVISATHCFIDYPKKEDYIVYLGRSRLNSNTQGEMKFEVENLILHKDYSADTVAQHNDIALLKIRSKEGRCAQPSRTIQTISLPSMYNDPQFGTSCEITGFGKENSTDYLFPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 180 - protein, 253 aa, synthetic construct
  REGION 1..253: note = UROKINASE-TYPE PLASMINOGEN ACTIVATOR (u-PA) protease domain F30H/V38D/V41R/L97bV/H99Q/C122S/Y149N/Y151F/M157K
IIGGEFTTIENQPWHAAIYRRHRGGSDTYRCGGSLISPCWVISATHCFIDYPKKEDYIVYLGRSRLNSNTQGEMKFEVENLILHKDYSADTVAQHNDIALLKIRSKEGRCAQPSRTIQTISLPSMYNDPQFGTSCEITGFGKENSTDNLFPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 181 - protein, 253 aa, synthetic construct
  REGION 1..253: note = UROKINASE-TYPE PLASMINOGEN ACTIVATOR (u-PA) protease domain F30Y/V38D/V41R/L97bV/H99Q/C122S/Y149N/Y151F/M157K
IIGGEFTTIENQPWYAAIYRRHRGGSDTYRCGGSLISPCWVISATHCFIDYPKKEDYIVYLGRSRLNSNTQGEMKFEVENLILHKDYSADTVAQHNDIALLKIRSKEGRCAQPSRTIQTISLPSMYNDPQFGTSCEITGFGKENSTDNLFPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 182 - protein, 253 aa, synthetic construct
  REGION 1..253: note = UROKINASE-TYPE PLASMINOGEN ACTIVATOR (u-PA) protease domain F30Y/V38D/Y40H/V41R/L97bA/H99Q/C122S/M157K/R217G
IIGGEFTTIENQPWYAAIYRRHRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGGGCALKDKPGVYTRVSHFLPWIRSHTKEENGLAL

SEQ ID NO: 183 - protein, 253 aa, synthetic construct
  REGION 1..253: note = UROKINASE-TYPE PLASMINOGEN ACTIVATOR (u-PA) protease domain F30Y/V38D/Y40H/V41R/L97bA/H99Q/C122S/M157K/R217E
IIGGEFTTIENQPWYAAIYRRHRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGEGCALKDKPGVYTRVSHFLPWIRSHTKEENGLAL

SEQ ID NO: 184 - protein, 253 aa, synthetic construct
  REGION 1..253: note = UROKINASE-TYPE PLASMINOGEN ACTIVATOR (u-PA) protease domain F30H/V38D/V41R/L97bA/H99Q/C122S/Y151L/M157K/R217D
IIGGEFTTIENQPWHAAIYRRHRGGSDTYRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLLPEQLKKTVVKLISHRECQQPHYYGSEVTTKMLCAADPQWKTDSCQGDSGGPLVCSLQGRMTLTGIVSWGDGCALKDKPGVYTRVSHFLPWIRSHTKEENGLAL

SEQ ID NO: 185 - protein, 253 aa, synthetic construct
  REGION 1..253: note = UROKINASE-TYPE PLASMINOGEN ACTIVATOR (u-PA) protease domain F30Y/V38D/Y40H/V41R/L97bA/H99Q/C122S/Y149L/M157K/R 217G
IIGGEFTTIENQPWYAAIYRRHRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDLLYPEQLKKTVVKLISHRECQQPHYYGSEVTTKMLCAADPQWKTDSCQGDSGGPLVCSLQGRMTLTGIVSWGGGCALKDKPGVYTRVSHFLPWIRSHTKEENGLAL

SEQ ID NO: 186 - protein, 253 aa, synthetic construct
  REGION 1..253: note = UROKINASE-TYPE PLASMINOGEN ACTIVATOR (u-PA) protease domain F30Y/V38D/Y40H/V41R/L97bA/H99Q/C122S/Y149L/M157K/R 217E
IIGGEFTTIENQPWYAAIYRRHRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDLLYPEQLKKTVVKLISHRECQQPHYYGSEVTTKMLCAADPQWKTDSCQGDSGGPLVCSLQGRMTLTGIVSWGEGCALKDKPGVYTRVSHFLPWIRSHTKEENGLAL

SEQ ID NO: 187 - protein, 253 aa, synthetic construct
  REGION 1..253: note = UROKINASE-TYPE PLASMINOGEN ACTIVATOR (u-PA) protease domain F30Y/V38D/Y40H/V41R/L97bA/H99Q/C122S/Y149L/M157K/R 217D
IIGGEFTTIENQPWYAAIYRRHRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDLLYPEQLKKTVVKLISHRECQQPHYYGSEVTTKMLCAADPQWKTDSCQGDSGGPLVCSLQGRMTLTGIVSWGDGCALKDKPGVYTRVSHFLPWIRSHTKEENGLAL

SEQ ID NO: 188 - protein, 253 aa, synthetic construct
  REGION 1..253: note = UROKINASE-TYPE PLASMINOGEN ACTIVATOR (u-PA) protease domain F30Y/V38D/Y40H/V41R/L97bA/H99Q/C122S/Y149F/M157K/R 217G
IIGGEFTTIENQPWYAAIYRRHRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDFLYPEQLKKTVVKLISHRECQQPHYYGSEVTTKMLCAADPQWKTDSCQGDSGGPLVCSLQGRMTLTGIVSWGGGCALKDKPGVYTRVSHFLPWIRSHTKEENGLAL

SEQ ID NO: 189 - protein, 253 aa, synthetic construct
  REGION 1..253: note = UROKINASE-TYPE PLASMINOGEN ACTIVATOR (u-PA) protease domain F30Y/V38D/Y40H/V41R/L97bA/H99Q/C122S/Y149F/M157K/R 217E
IIGGEFTTIENQPWYAAIYRRHRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDFLYPEQLKKTVVKLISHRECQQPHYYGSEVTTKMLCAADPQWKTDSCQGDSGGPLVCSLQGRMTLTGIVSWGEGCALKDKPGVYTRVSHFLPWIRSHTKEENGLAL

SEQ ID NO: 190 - protein, 253 aa, synthetic construct
  REGION 1..253: note = UROKINASE-TYPE PLASMINOGEN ACTIVATOR (u-PA) protease domain F30Y/V38D/Y40H/V41R/L97bA/H99Q/C122S/Y149F/M157K/R 217D
IIGGEFTTIENQPWYAAIYRRHRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDFLYPEQLKKTVVKLISHRECQQPHYYGSEVTTKMLCAADPQWKTDSCQGDSGGPLVCSLQGRMTLTGIVSWGDGCALKDKPGVYTRVSHFLPWIRSHTKEENGLAL

SEQ ID NO: 191 - protein, 253 aa, synthetic construct
  REGION 1..253: note = UROKINASE-TYPE PLASMINOGEN ACTIVATOR (u-PA) protease domain F30Y/R35Q/V38D/Y40H/V41R/L97bA/H99Q/C122S/Y149L/M1 57K/R217E
IIGGEFTTIENQPWYAAIYQRHRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDLLYPEQLKKTVVKLISHRECQQPHYYGSEVTTKMLCAADPQWKTDSCQGDSGGPLVCSLQGRMTLTGIVSWGEGCALKDKPGVYTRVSHFLPWIRSHTKEENGLAL

SEQ ID NO: 192 - protein, 253 aa, synthetic construct
  REGION 1..253: note = UROKINASE-TYPE PLASMINOGEN ACTIVATOR (u-PA) protease domain F30Y/R35Q/V38D/Y40H/V41R/L97bA/H99Q/C122S/Y149L/M1 57K/R217G
IIGGEFTTIENQPWYAAIYQRHRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDLLYPEQLKKTVVKLISHRECQQPHYYGSEVTTKMLCAADPQWKTDSCQGDSGGPLVCSLQGRMTLTGIVSWGGGCALKDKPGVYTRVSHFLPWIRSHTKEENGLAL

SEQ ID NO: 193 - protein, 253 aa, synthetic construct
  REGION 1..253: note = UROKINASE-TYPE PLASMINOGEN ACTIVATOR (u-PA) protease domain F30Y/H37D/V38D/Y40H/V41R/L97bA/H99Q/C122S/Y149L/M1 57K/R217E
IIGGEFTTIENQPWYAAIYRRDRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDLLYPEQLKKTVVKLISHRECQQPHYYGSEVTTKMLCAADPQWKTDSCQGDSGGPLVCSLQGRMTLTGIVSWGEGCALKDKPGVYTRVSHFLPWIRSHTKEENGLAL

SEQ ID NO: 194 - protein, 253 aa, synthetic construct
  REGION 1..253: note = UROKINASE-TYPE PLASMINOGEN ACTIVATOR (u-PA) protease domain F30Y/H37D/V38D/Y40H/V41R/L97bA/H99Q/C122S/Y149L/M1 57K/R217G
IIGGEFTTIENQPWYAAIYRRDRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDLLYPEQLKKTVVKLISHRECQQPHYYGSEVTTKMLCAADPQWKTDSCQGDSGGPLVCSLQGRMTLTGIVSWGGGCALKDKPGVYTRVSHFLPWIRSHTKEENGLAL

SEQ ID NO: 195 - protein, 254 aa, synthetic construct
  REGION 1..254: note = UROKINASE-TYPE PLASMINOGEN ACTIVATOR (u-PA) protease domain F30Y/V38D/Y40H/V41R/L97bA/H99Q/C122S/Y149L/M157K
IIGGEFTTIENQPWYAAIYRRHRGGSDTHRCGGSLISPCWVISATHCFIDYPKKEDYIVYLGRSRLNSNTQGEMKFEVENLILHKDYSADTAAQHHNDIALLKIRSKEGRCAQPSRTIQTISLPSMYNDPQFGTSCEITGFGKENSTDLLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 196 - protein, 254 aa, synthetic construct
  REGION 1..254: note = UROKINASE-TYPE PLASMINOGEN ACTIVATOR (u-PA) protease domain F30Y/V38D/Y40H/V41R/L97bA/H99Q/C122S/Y149F/M157K
IIGGEFTTIENQPWYAAIYRRHRGGSDTHRCGGSLISPCWVISATHCFIDYPKKEDYIVYLGRSRLNSNTQGEMKFEVENLILHKDYSADTAAQHHNDIALLKIRSKEGRCAQPSRTIQTISLPSMYNDPQFGTSCEITGFGKENSTDFLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 197 - protein, 253 aa, synthetic construct
  REGION 1..253: note = UROKINASE-TYPE PLASMINOGEN ACTIVATOR (u-PA) protease domain I17L/F30Y/V38D/Y40H/V41R/L97bA/H99Q/C122S/M157K
ILGGEFTTIENQPWYAAIYRRHRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 198 - protein, 253 aa, synthetic construct
  REGION 1..253: note = UROKINASE-TYPE PLASMINOGEN ACTIVATOR (u-PA) protease domain I17V/F30Y/V38D/Y40H/V41R/L97bA/H99Q/C122S/M157K
IVGGEFTTIENQPWYAAIYRRHRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 199 - protein, 254 aa, synthetic construct
  REGION 1..254: note = UROKINASE-TYPE PLASMINOGEN ACTIVATOR (u-PA) protease domain F30Y/V38D/Y40H/V41R/L97bA/H99Q/C122S/Y149W/M157K
IIGGEFTTIENQPWYAAIYRRHRGGSDTHRCGGSLISPCWVISATHCFIDYPKKEDYIVYLGRSRLNSNTQGEMKFEVENLILHKDYSADTAAQHHNDIALLKIRSKEGRCAQPSRTIQTISLPSMYNDPQFGTSCEITGFGKENSTDWLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 200 - protein, 254 aa, synthetic construct
  REGION 1..254: note = UROKINASE-TYPE PLASMINOGEN ACTIVATOR (u-PA) protease domain F30Y/R35Q/V38D/Y40H/V41R/L97bA/H99Q/C122S/Y149L/M1 57K
IIGGEFTTIENQPWYAAIYQRHRGGSDTHRCGGSLISPCWVISATHCFIDYPKKEDYIVYLGRSRLNSNTQGEMKFEVENLILHKDYSADTAAQHHNDIALLKIRSKEGRCAQPSRTIQTISLPSMYNDPQFGTSCEITGFGKENSTDLLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 201 - protein, 254 aa, synthetic construct
  REGION 1..254: note = UROKINASE-TYPE PLASMINOGEN ACTIVATOR (u-PA) protease domain F30Y/R35Q/V38D/Y40H/V41R/L97bA/H99Q/C122S/Y149W/M1 57K
IIGGEFTTIENQPWYAAIYQRHRGGSDTHRCGGSLISPCWVISATHCFIDYPKKEDYIVYLGRSRLNSNTQGEMKFEVENLILHKDYSADTAAQHHNDIALLKIRSKEGRCAQPSRTIQTISLPSMYNDPQFGTSCEITGFGKENSTDWLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 202 - protein, 254 aa, synthetic construct
  REGION 1..254: note = UROKINASE-TYPE PLASMINOGEN ACTIVATOR (u-PA) protease domain F30Y/R35Q/V38D/Y40H/V41R/L97bA/H99Q/C122S/Y149F/M1 57K
IIGGEFTTIENQPWYAAIYQRHRGGSDTHRCGGSLISPCWVISATHCFIDYPKKEDYIVYLGRSRLNSNTQGEMKFEVENLILHKDYSADTAAQHHNDIALLKIRSKEGRCAQPSRTIQTISLPSMYNDPQFGTSCEITGFGKENSTDFLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 203 - protein, 253 aa, synthetic construct
  REGION 1..253: note = UROKINASE-TYPE PLASMINOGEN ACTIVATOR (u-PA) protease domain F30Y/R35Q/V38D/Y40H/V41R/L97bA/H99Q/C122S/M157K
IIGGEFTTIENQPWYAAIYQRHRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 204 - protein, 253 aa, synthetic construct
  REGION 1..253: note = UROKINASE-TYPE PLASMINOGEN ACTIVATOR (u-PA) protease domain F30Y/H37T/V38D/Y40H/V41R/L97bA/H99Q/C122S/Y149L/M1 57K
IIGGEFTTIENQPWYAAIYRRTRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDLLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 205 - protein, 253 aa, synthetic construct
  REGION 1..253: note = UROKINASE-TYPE PLASMINOGEN ACTIVATOR (u-PA) protease domain F30Y/H37T/V38D/Y40H/V41R/L97bA/H99Q/C122S/Y149F/M1 57K
IIGGEFTTIENQPWYAAIYRRTRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDFLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 206 - protein, 253 aa, synthetic construct
  REGION 1..253: note = UROKINASE-TYPE PLASMINOGEN ACTIVATOR (u-PA) protease domain F30Y/H37T/V38D/Y40H/V41R/L97bA/H99Q/C122S/M157K
IIGGEFTTIENQPWYAAIYRRTRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 207 - protein, 253 aa, synthetic construct
  REGION 1..253: note = UROKINASE-TYPE PLASMINOGEN ACTIVATOR (u-PA) protease domain F30Y/R35Q/H37T/V38D/Y40H/V41R/L97bA/H99Q/C122S/Y14 9L/M157K
IIGGEFTTIENQPWYAAIYQRTRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDLLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 208 - protein, 253 aa, synthetic construct
  REGION 1..253: note = UROKINASE-TYPE PLASMINOGEN ACTIVATOR (u-PA) protease domain F30Y/R35Q/H37T/V38D/Y40H/V41R/L97bA/H99Q/C122S/Y14 9W/M157K
IIGGEFTTIENQPWYAAIYQRTRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDWLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 209 - protein, 253 aa, synthetic construct
  REGION 1..253: note = UROKINASE-TYPE PLASMINOGEN ACTIVATOR (u-PA) protease domain F30Y/R35Q/H37T/V38D/Y40H/V41R/L97bA/H99Q/C122S/Y14 9F/M157K
IIGGEFTTIENQPWYAAIYQRTRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDFLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 210 - protein, 253 aa, synthetic construct
  REGION 1..253: note = UROKINASE-TYPE PLASMINOGEN ACTIVATOR (u-PA) protease domain F30Y/R35Q/H37T/V38D/Y40H/V41R/L97bA/H99Q/C122S/M15 7K
IIGGEFTTIENQPWYAAIYQRTRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 211 - protein, 253 aa, synthetic construct
  REGION 1..253: note = UROKINASE-TYPE PLASMINOGEN ACTIVATOR (u-PA) protease domain F30Y/V38D/Y40H/V41R/T56A/L97bA/H99Q/C122S/M157K
IIGGEFTTIENQPWYAAIYRRHRGGSDTHRCGGSLISPCWVISAAHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 212 - protein, 253 aa, synthetic construct
  REGION 1..253: note = UROKINASE-TYPE PLASMINOGEN ACTIVATOR (u-PA) protease domain F30Y/V38D/Y40H/V41R/L97bA/H99Q/C122S/Y151F/M157K
IIGGEFTTIENQPWYAAIYRRHRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLFPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 213 - protein, 253 aa, synthetic construct
  REGION 1..253: note = UROKINASE-TYPE PLASMINOGEN ACTIVATOR (u-PA) protease domain V38D/L97bA/H99Q/C122S/M157K/T158A
IIGGEFTTIENQPWFAAIYRRHRGGSDTYVCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKKAVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 214 - protein, 253 aa, synthetic construct
  REGION 1..253: note = UROKINASE-TYPE PLASMINOGEN ACTIVATOR (u-PA) protease domain V38D/V41R/L97bA/H99Q/C122S/M157K/T158A
IIGGEFTTIENQPWFAAIYRRHRGGSDTYRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKKAVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 215 - protein, 253 aa, synthetic construct
  REGION 1..253: note = UROKINASE-TYPE PLASMINOGEN ACTIVATOR (u-PA) protease domain F30Y/R37aH/V38D/Y40Q/V41I/L97bA/H99Q/C122S/Y151L/M 157W/Q192Y
IIGGEFTTIENQPWYAAIYRRHHGGSDTQICGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLLPEQLKWTVVKLISHRECQQPHYYGSEVTTKMLCAADPQWKTDSCYGDSGGPLVCSLQGRMTLTGIVSWGRGCALKDKPGVYTRVSHFLPWIRSHTKEENGLAL

SEQ ID NO: 216 - protein, 253 aa, synthetic construct
  REGION 1..253: note = UROKINASE-TYPE PLASMINOGEN ACTIVATOR (u-PA) protease domain I17V/F30Y/R35Q/H37W/V38D/Y40H/V41R/Y60bN/L97bA/H99 Q/C122S/Y149H/M157K
IVGGEFTTIENQPWYAAIYQRWRGGSDTHRCGGSLISPCWVISATHCFIDNPKKEDYIVYLGRSRLNSNTQGEMKFEVENLILHKDYSADTAAQHNDIALLKIRSKEGRCAQPSRTIQTISLPSMYNDPQFGTSCEITGFGKENSTDHLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 217 - protein, 253 aa, synthetic construct
  REGION 1..253: note = UROKINASE-TYPE PLASMINOGEN ACTIVATOR (u-PA) protease domain F30Y/R35Q/H37W/V38D/Y40H/V41R/Y60bN/L97bA/H99Q/C12 2S/Y149H/M157K/T158A
IIGGEFTTIENQPWYAAIYQRWRGGSDTHRCGGSLISPCWVISATHCFIDNPKKEDYIVYLGRSRLNSNTQGEMKFEVENLILHKDYSADTAAQHNDIALLKIRSKEGRCAQPSRTIQTISLPSMYNDPQFGTSCEITGFGKENSTDHLYPEQLKKAVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 218 - protein, 253 aa, synthetic construct
  REGION 1..253: note = UROKINASE-TYPE PLASMINOGEN ACTIVATOR (u-PA) protease domain I17V/F30Y/R35Q/H37W/V38D/Y40H/V41R/Y60bN/L97bA/H99 Q/C122S/Y149H/M157K/T158A
IVGGEFTTIENQPWYAAIYQRWRGGSDTHRCGGSLISPCWVISATHCFIDNPKKEDYIVYLGRSRLNSNTQGEMKFEVENLILHKDYSADTAAQHNDIALLKIRSKEGRCAQPSRTIQTISLPSMYNDPQFGTSCEITGFGKENSTDHLYPEQLKKAVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 219 - protein, 253 aa, synthetic construct
  REGION 1..253: note = UROKINASE-TYPE PLASMINOGEN ACTIVATOR (u-PA) protease domain I17V/F30Y/V38D/Y40H/V41R/L97bA/H99Q/C122S/M157K/T1 58A
IVGGEFTTIENQPWYAAIYRRHRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKKAVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 220 - protein, 253 aa, synthetic construct
  REGION 1..253: note = UROKINASE-TYPE PLASMINOGEN ACTIVATOR (u-PA) protease domain V38D/V41R/L97bA/H99Q/C122S
IIGGEFTTIENQPWFAAIYRRHRGGSDTYRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 221 - protein, 253 aa, synthetic construct
  REGION 1..253: note = UROKINASE-TYPE PLASMINOGEN ACTIVATOR (u-PA) protease domain F30Y/R35Q/R36H/H37W/V38E/Y40H/V41R/T97aI/L97bA/H99 Q/C122S/M157K
IIGGEFTTIENQPWYAAIYQHWRGGSETHRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 222 - protein, 253 aa, synthetic construct
  REGION 1..253: note = UROKINASE-TYPE PLASMINOGEN ACTIVATOR (u-PA) protease domain I17V/F30Y/R36H/V38E/Y40H/V41R/T97aI/L97bA/H99Q/C12 2S/M157K
IVGGEFTTIENQPWYAAIYRHHRGGSETHRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 223 - protein, 253 aa, synthetic construct
  REGION 1..253: note = UROKINASE-TYPE PLASMINOGEN ACTIVATOR (u-PA) protease domain I17V/F30Y/R35Q/R36H/H37W/V38E/Y40H/V41R/T97aI/L97b A/H99Q/C122S/M157K
IVGGEFTTIENQPWYAAIYQHWRGGSETHRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 224 - protein, 253 aa, synthetic construct
  REGION 1..253: note = UROKINASE-TYPE PLASMINOGEN ACTIVATOR (u-PA) protease domain F30Y/R36H/V38E/Y40H/V41R/T97aI/L97bA/H99Q/C122S/M1 57K/T158A
IIGGEFTTIENQPWYAAIYRHHRGGSETHRCGGSLISPCWVISATHCFIDYPKKEDYIVYLGRSRLNSNTQGEMKFEVENLILHKDYSADAIAQHNDIALLKIRSKEGRCAQPSRTIQTISLPSMYNDPQFGTSCEITGFGKENSTDYLYPEQLKKAVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 225 - protein, 253 aa, synthetic construct
  REGION 1..253: note = UROKINASE-TYPE PLASMINOGEN ACTIVATOR (u-PA) protease domain I17V/F30Y/R35Q/R36H/H37W/V38E/Y40H/V41R/T97aI/L97b A/H99Q/C122S/M157K/T158A
IVGGEFTTIENQPWYAAIYQHWRGGSETHRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDYLYPEQLKKAVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 226 - protein, 253 aa, synthetic construct
  REGION 1..253: note = UROKINASE-TYPE PLASMINOGEN ACTIVATOR (u-PA) protease domain F30Y/R36H/V38E/Y40H/V41R/T97aI/L97bA/H99Q/C122S/Y1 49R/M157K
IIGGEFTTIENQPWYAAIYRHHRGGSETHRCGGSLISPCWVISATHCFIDYPKKEDYIVYLGRSRLNSNTQGEMKFEVENLILHKDYSADAIAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 227 - protein, 253 aa, synthetic construct
  REGION 1..253: note = UROKINASE-TYPE PLASMINOGEN ACTIVATOR (u-PA) protease domain I17V/F30Y/V38D/Y40H/V41R/L97bA/H99Q/C122S/Y149R/M1 57K
IVGGEFTTIENQPWYAAIYRRHRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 228 - protein, 253 aa, synthetic construct
  REGION 1..253: note = UROKINASE-TYPE PLASMINOGEN ACTIVATOR (u-PA) protease domain F30Y/R35Q/H37W/V38D/Y40H/V41R/Y60bN/L97bA/H99Q/C12 2S/Y149R/M157K
IIGGEFTTIENQPWYAAIYQRWRGGSDTHRCGGSLISPCWVISATHCFIDNPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 229 - protein, 253 aa, synthetic construct
  REGION 1..253: note = UROKINASE-TYPE PLASMINOGEN ACTIVATOR (u-PA) protease domain F30Y/V38D/Y40H/V41R/L97bA/H99Q/C122S/Y149R/M157K
IIGGEFTTIENQPWYAAIYRRHRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 230 - protein, 253 aa, synthetic construct
  REGION 1..253: note = UROKINASE-TYPE PLASMINOGEN ACTIVATOR (u-PA) protease domain F30Y/R36H/V38E/Y40H/V41R/K61E/T97aI/L97bA/H99Q/C12 2S/M157K
IIGGEFTTIENQPWYAAIYRHHRGGSETHRCGGSLISPCWVISATHCFIDYPEKEDYIVYLGRSRLNSNTQGEMKFEVENLILHKDYSADIAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 231 - protein, 253 aa, synthetic construct
  REGION 1..253: note = UROKINASE-TYPE PLASMINOGEN ACTIVATOR (u-PA) protease domain F30Y/R36H/R37aH/V38E/Y40H/V41R/K61E/T97aI/L97bA/H9 9Q/C122S/M157K
IIGGEFTTIENQPWYAAIYRHHHGGSETHRCGGSLISPCWVISATHCFIDYPEKEDYIVYLGRSRLNSNTQGEMKFEVENLILHKDYSADIAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 232 - protein, 253 aa, synthetic construct
  REGION 1..253: note = UROKINASE-TYPE PLASMINOGEN ACTIVATOR (u-PA) protease domain F30Y/R36H/V38E/Y40H/V41R/K61E/T97aI/L97bA/H99Q/C12 2S/Y149R/M157K
IIGGEFTTIENQPWYAAIYRHHRGGSETHRCGGSLISPCWVISATHCFIDYPEKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 233 - protein, 253 aa, synthetic construct
  REGION 1..253: note = UROKINASE-TYPE PLASMINOGEN ACTIVATOR (u-PA) protease domain F30Y/R36H/R37aH/V38E/Y40H/V41R/K61E/T97aI/L97bA/H9 9Q/C122S/Y149R/M157K
IIGGEFTTIENQPWYAAIYRHHHGGSETHRCGGSLISPCWVISATHCFIDYPEKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 234 - protein, 253 aa, synthetic construct
  REGION 1..253: note = UROKINASE-TYPE PLASMINOGEN ACTIVATOR (u-PA) protease domain F30Y/R35Q/H37D/V38D/Y40H/V41R/D60aE/Y60bN/L97bA/H9 9Q/C122S/Y149S/M157K
IIGGEFTTIENQPWYAAIYQRDRGGSDTHRCGGSLISPCWVISATHCFIENPKKEDYIVYLGRSRLNSNTQGEMKFEVENLILHKDYSADTAAQHNDIALLKIRSKEGRCAQPSRTIQTISLPSMYNDPQFGTSCEITGFGKENSTDSLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 235 - protein, 253 aa, synthetic construct
  REGION 1..253: note = UROKINASE-TYPE PLASMINOGEN ACTIVATOR (u-PA) protease domain F30Y/R35Q/H37T/V38D/Y40H/V41R/D60aE/Y60bN/L97bA/H9 9Q/C122S/Y149L/M157K
IIGGEFTTIENQPWYAAIYQRTRGGSDTHRCGGSLISPCWVISATHCFIENPKKEDYIVYLGRSRLNSNTQGEMKFEVENLILHKDYSADTAAQHNDIALLKIRSKEGRCAQPSRTIQTISLPSMYNDPQFGTSCEITGFGKENSTDLLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 236 - protein, 253 aa, synthetic construct
  REGION 1..253: note = UROKINASE-TYPE PLASMINOGEN ACTIVATOR (u-PA) protease domain F30Y/R35Q/V38D/Y40H/V41R/Y60bE/L97bA/H99Q/C122S/Y1 49Q/M157K/R217S
IIGGEFTTIENQPWYAAIYQRHRGGSDTHRCGGSLISPCWVISATHCFIDEPKKEDYIVYLGRSRLNSNTQGEMKFEVENLILHKDYSADTAAQHNDIALLKIRSKEGRCAQPSRTIQTISLPSMYNDPQFGTSCEITGFGKENSTDQLYPEQLKKTVVKLISHRECQQPHYYGSEVTTKMLCAADPQWKTDSCQGDSGGPLVCSLQGRMTLTGIVSWGSGCALKDKPGVYTRVSHFLPWIRSHTKEENGLAL

SEQ ID NO: 237 - protein, 253 aa, synthetic construct
  REGION 1..253: note = UROKINASE-TYPE PLASMINOGEN ACTIVATOR (u-PA) protease domain F30Y/R35Q/V38Y/Y40H/V41R/D60aE/Y60bE/L97bA/H99Q/C1 22S/Y149V/M157K/R217M
IIGGEFTTIENQPWYAAIYQRHRGGSYTHRCGGSLISPCWVISATHCFIEEPKKEDYIVYLGRSRLNSNTQGEMKFEVENLILHKDYSADTAAQHNDIALLKIRSKEGRCAQPSRTIQTISLPSMYNDPQFGTSCEITGFGKENSTDVLYPEQLKKTVVKLISHRECQQPHYYGSEVTTKMLCAADPQWKTDSCQGDSGGPLVCSLQGRMTLTGIVSWGMGCALKDKPGVYTRVSHFLPWIRSHTKEENGLAL

SEQ ID NO: 238 - protein, 253 aa, synthetic construct
  REGION 1..253: note = UROKINASE-TYPE PLASMINOGEN ACTIVATOR (u-PA) protease domain F30Y/R35Q/V38D/Y40H/V41R/D60aE/Y60bS/L97bA/H99Q/C1 22S/Y149T/M157K
IIGGEFTTIENQPWYAAIYQRHRGGSDTHRCGGSLISPCWVISATHCFIESPKKEDYIVYLGRSRLNSNTQGEMKFEVENLILHKDYSADTAAQHNDIALLKIRSKEGRCAQPSRTIQTISLPSMYNDPQFGTSCEITGFGKENSTDTLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 239 - protein, 253 aa, synthetic construct
  REGION 1..253: note = UROKINASE-TYPE PLASMINOGEN ACTIVATOR (u-PA) protease domain F30Y/R35Q/V38D/Y40H/V41R/D60aE/Y60bE/L97bA/H99Q/C1 22S/Y149L/M157K/R217S
IIGGEFTTIENQPWYAAIYQRHRGGSDTHRCGGSLISPCWVISATHCFIEEPKKEDYIVYLGRSRLNSNTQGEMKFEVENLILHKDYSADTAAQHNDIALLKIRSKEGRCAQPSRTIQTISLPSMYNDPQFGTSCEITGFGKENSTDLLYPEQLKKTVVKLISHRECQQPHYYGSEVTTKMLCAADPQWKTDSCQGDSGGPLVCSLQGRMTLTGIVSWGSGCALKDKPGVYTRVSHFLPWIRSHTKEENGLAL

SEQ ID NO: 240 - protein, 253 aa, synthetic construct
  REGION 1..253: note = UROKINASE-TYPE PLASMINOGEN ACTIVATOR (u-PA) protease domain F30Y/R35Q/H37Y/V38D/Y40H/V41R/Y60bE/L97bA/H99Q/C12 2S/Y149R/M157K
IIGGEFTTIENQPWYAAIYQRYRGGSDTHRCGGSLISPCWVISATHCFIDEPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 241 - protein, 253 aa, synthetic construct
  REGION 1..253: note = UROKINASE-TYPE PLASMINOGEN ACTIVATOR (u-PA) protease domain F30Y/V38D/Y40H/V41R/L97bA/H99Q/C122S/M157K/Q192H
IIGGEFTTIENQPWYAAIYRRHRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCHGDSGGPLVCSLQGRMTLTGIVSWGRGCALKDKPGVYTRVSHFLPWIRSHTKEENGLAL

SEQ ID NO: 242 - protein, 253 aa, synthetic construct
  REGION 1..253: note = UROKINASE-TYPE PLASMINOGEN ACTIVATOR (u-PA) protease domain F30Y/R36H/V38E/Y40H/V41R/I65T/T97aI/L97bA/H99Q/C12 2S/M157K
IIGGEFTTIENQPWYAAIYRHHRGGSETHRCGGSLISPCWVISATHCFIDYPKKEDYTVYLGRSRLNSNTQGEMKFEVENLILHKDYSADIAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 243 - protein, 253 aa, synthetic construct
  REGION 1..253: note = UROKINASE-TYPE PLASMINOGEN ACTIVATOR (u-PA) protease domain F30Y/R36H/V38E/Y40L/V41R/T97aI/L97bA/H99Q/C122S/M1 57K
IIGGEFTTIENQPWYAAIYRHHRGGSETLRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 244 - protein, 253 aa, synthetic construct
  REGION 1..253: note = UROKINASE-TYPE PLASMINOGEN ACTIVATOR (u-PA) protease domain F30Y/R36H/V38E/Y40H/V41R/T97aI/L97bA/H99Q/C122S/M1 57K/Q192H
IIGGEFTTIENQPWYAAIYRHHRGGSETHRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCHGDSGGPLVCSLQGRMTLTGIVSWGRGCALKDKPGVYTRVSHFLPWIRSHTKEENGLAL

SEQ ID NO: 245 - protein, 253 aa, synthetic construct
  REGION 1..253: note = UROKINASE-TYPE PLASMINOGEN ACTIVATOR (u-PA) protease domain N26D/F30Y/R36H/R37aH/V38E/Y40H/V41R/K61E/I65T/L97b A/H99Q/C122S/M126I/M157K
IIGGEFTTIEDQPWYAAIYRHHHGGSETHRCGGSLISPCWVISATHCFIDYPEKEDYTVYLGRSRLNSNTQGEMKFEVENLILHKDYSADTAAQHNDIALLKIRSKEGRCAQPSRTIQTISLPSIYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 246 - protein, 253 aa, synthetic construct
  REGION 1..253: note = UROKINASE-TYPE PLASMINOGEN ACTIVATOR (u-PA) protease domain N26D/F30Y/V38D/Y40H/V41R/I65T/L97bA/H99Q/C122S/M12 6I/M157K/Q192H
IIGGEFTTIEDQPWYAAIYRRHRGGSDTHRCGGSLISPCWVISATHCFIDYPKKEDYTVYLGRSRLNSNTQGEMKFEVENLILHKDYSADTAAQHNDIALLKIRSKEGRCAQPSRTIQTISLPSIYNDPQFGTSCEITGFGKENSTDYLYPEQLKKTVVKLISHRECQQPHYYGSEVTTKMLCAADPQWKTDSCHGDSGGPLVCSLQGRMTLTGIVSWGRGCALKDKPGVYTRVSHFLPWIRSHTKEENGLAL

SEQ ID NO: 247 - protein, 253 aa, synthetic construct
  REGION 1..253: note = UROKINASE-TYPE PLASMINOGEN ACTIVATOR (u-PA) protease domain N26D/F30Y/V38D/Y40L/V41R/I65T/L97bA/H99Q/C122S/M12 6I/M157K
IIGGEFTTIEDQPWYAAIYRRHRGGSDTLRCGGSLISPCWVISATHCFIDYPKKEDYTVYLGRSRLNSNTQGEMKFEVENLILHKDYSADTAAQHNDIALLKIRSKEGRCAQPSRTIQTISLPSIYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 248 - protein, 253 aa, synthetic construct
  REGION 1..253: note = UROKINASE-TYPE PLASMINOGEN ACTIVATOR (u-PA) protease domain N26D/F30Y/V38D/Y40H/V41R/I65T/L97bA/H99Q/C122S/M12 6I/Y149R/M157K
IIGGEFTTIEDQPWYAAIYRRHRGGSDTHRCGGSLISPCWVISATHCFIDYPKKEDYTVYLGRSRLNSNTQGEMKFEVENLILHKDYSADTAAQHNDIALLKIRSKEGRCAQPSRTIQTISLPSIYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 249 - protein, 253 aa, synthetic construct
  REGION 1..253: note = UROKINASE-TYPE PLASMINOGEN ACTIVATOR (u-PA) protease domain F30Y/R36H/V38E/Y40H/V41R/I65T/T97aI/L97bA/H99Q/C12 2S/Y149R/M157K
IIGGEFTTIENQPWYAAIYRHHRGGSETHRCGGSLISPCWVISATHCFIDYPKKEDYTVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 250 - protein, 253 aa, synthetic construct
  REGION 1..253: note = UROKINASE-TYPE PLASMINOGEN ACTIVATOR (u-PA) protease domain F30Y/V38D/Y40L/V41R/L97bA/H99Q/C122S/M157K
IIGGEFTTIENQPWYAAIYRRHRGGSDTLRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 251 - protein, 253 aa, synthetic construct
  REGION 1..253: note = UROKINASE-TYPE PLASMINOGEN ACTIVATOR (u-PA) protease domain F30Y/V38D/Y40L/V41R/L97bA/H99Q/C122S/M157K/Q192H
IIGGEFTTIENQPWYAAIYRRHRGGSDTLRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCHGDSGGPLVCSLQGRMTLTGIVSWGRGCALKDKPGVYTRVSHFLPWIRSHTKEENGLAL

SEQ ID NO: 252 - protein, 253 aa, synthetic construct
  REGION 1..253: note = UROKINASE-TYPE PLASMINOGEN ACTIVATOR (u-PA) protease domain F30Y/R36H/V38E/Y40L/V41R/T97aI/L97bA/H99Q/C122S/M1 57K/Q192H
IIGGEFTTIENQPWYAAIYRHHRGGSETLRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCHGDSGGPLVCSLQGRMTLTGIVSWGRGCALKDKPGVYTRVSHFLPWIRSHTKEENGLAL

SEQ ID NO: 253 - protein, 253 aa, synthetic construct
  REGION 1..253: note = UROKINASE-TYPE PLASMINOGEN ACTIVATOR (u-PA) protease domain F30Y/R35W/R36H/H37E/V38E/T39S/Y40H/V41W/Y60bW/T97a I/L97bA/H99Q/C122S/Y149R/M157K/Q192Y
IIGGEFTTIENQPWYAAIYWHERGGSESHWCGGSLISPCWVISATHCFIDWPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCYGDSGGPLVCSLQGRMTLTGIVSWGRGCALKDKPGVYTRVSHFLPWIRSHTKEENGLAL

SEQ ID NO: 254 - protein, 253 aa, synthetic construct
  REGION 1..253: note = UROKINASE-TYPE PLASMINOGEN ACTIVATOR (u-PA) protease domain F30Y/R35W/R36H/H37E/V38E/T39W/Y40H/V41R/Y60bH/T97a I/L97bA/H99Q/C122S/Y149R/M157K/Q192A
IIGGEFTTIENQPWYAAIYWHERGGSEWHRCGGSLISPCWVISATHCFIDHPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCAGDSGGPLVCSLQGRMTLTGIVSWGRGCALKDKPGVYTRVSHFLPWIRSHTKEENGLAL

SEQ ID NO: 255 - protein, 253 aa, synthetic construct
  REGION 1..253: note = UROKINASE-TYPE PLASMINOGEN ACTIVATOR (u-PA) protease domain F30Y/R35W/R36H/H37E/V38E/T39Q/Y40H/V41W/Y60bW/T97a I/L97bA/H99Q/C122S/Y149R/M157K/Q192F
IIGGEFTTIENQPWYAAIYWHERGGSEQHWCGGSLISPCWVISATHCFIDWPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCFGDSGGPLVCSLQGRMTLTGIVSWGRGCALKDKPGVYTRVSHFLPWIRSHTKEENGLAL

SEQ ID NO: 256 - protein, 253 aa, synthetic construct
  REGION 1..253: note = UROKINASE-TYPE PLASMINOGEN ACTIVATOR (u-PA) protease domain F30Y/R35W/R36H/H37E/V38E/T39R/Y40H/V41W/Y60bW/T97a I/L97bA/H99Q/C122S/Y149R/M157K/Q192Y
IIGGEFTTIENQPWYAAIYWHERGGSERHWCGGSLISPCWVISATHCFIDWPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCYGDSGGPLVCSLQGRMTLTGIVSWGRGCALKDKPGVYTRVSHFLPWIRSHTKEENGLAL

SEQ ID NO: 257 - protein, 253 aa, synthetic construct
  REGION 1..253: note = UROKINASE-TYPE PLASMINOGEN ACTIVATOR (u-PA) protease domain F30Y/R35Y/R36H/H37E/V38E/T39S/Y40H/V41W/Y60bW/T97a I/L97bA/H99Q/C122S/Y149R/M157K/Q192F
IIGGEFTTIENQPWYAAIYYHERGGSESHWCGGSLISPCWVISATHCFIDWPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCFGDSGGPLVCSLQGRMTLTGIVSWGRGCALKDKPGVYTRVSHFLPWIRSHTKEENGLAL

SEQ ID NO: 258 - protein, 253 aa, synthetic construct
  REGION 1..253: note = UROKINASE-TYPE PLASMINOGEN ACTIVATOR (u-PA) protease domain F30Y/R35Y/R36H/H37E/V38E/T39R/Y40H/V41W/Y60bW/T97a I/L97bA/H99Q/C122S/Y149R/M157K/Q192H
IIGGEFTTIENQPWYAAIYYHERGGSERHWCGGSLISPCWVISATHCFIDWPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCHGDSGGPLVCSLQGRMTLTGIVSWGRGCALKDKPGVYTRVSHFLPWIRSHTKEENGLAL

SEQ ID NO: 259 - protein, 253 aa, synthetic construct
  REGION 1..253: note = UROKINASE-TYPE PLASMINOGEN ACTIVATOR (u-PA) protease domain F30Y/R35Y/R36H/H37E/V38E/T39R/Y40H/V41W/Y60bW/T97a I/L97bA/H99Q/C122S/Y149R/M157K/Q192F
IIGGEFTTIENQPWYAAIYYHERGGSERHWCGGSLISPCWVISATHCFIDWPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCFGDSGGPLVCSLQGRMTLTGIVSWGRGCALKDKPGVYTRVSHFLPWIRSHTKEENGLAL

SEQ ID NO: 260 - protein, 253 aa, synthetic construct
  REGION 1..253: note = UROKINASE-TYPE PLASMINOGEN ACTIVATOR (u-PA) protease domain I17V/F30Y/R35W/R36H/H37E/V38E/T39W/Y40H/V41R/Y60bQ /T97aE/L97bA/H99Q/C122S/Y149K/M157K
IVGGEFTTIENQPWYAAIYWHERGGSEWHRCGGSLISPCWVISATHCFIDQPKKEDYIVYLGRSRLNSNTQGEMKFEVENLILHKDYSADEAAQHNDIALLKIRSKEGRCAQPSRTIQTISLPSMYNDPQFGTSCEITGFGKENSTDKLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 261 - protein, 253 aa, synthetic construct
  REGION 1..253: note = UROKINASE-TYPE PLASMINOGEN ACTIVATOR (u-PA) protease domain F30Y/R35W/R36Q/H37E/V38A/T39W/Y40H/V41R/Y60bQ/K61D /I65V/T97aE/L97bA/H99Q/C122S/Y149K/M157K
IIGGEFTTIENQPWYAAIYWQERGGSAWHRCGGSLISPCWVISATHCFIDQPDKEDYVVYLGRSRLNSNTQGEMKFEVENLILHKDYSADEAAQHNDIALLKIRSKEGRCAQPSRTIQTISLPSMYNDPQFGTSCEITGFGKENSTDKLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 262 - protein, 253 aa, synthetic construct
  REGION 1..253: note = UROKINASE-TYPE PLASMINOGEN ACTIVATOR (u-PA) protease domain F30Y/R35W/R36Q/H37E/V38E/T39W/Y40H/V41R/Y60bQ/K61L /I65V/T97aE/L97bA/H99Q/C122S/Y149K/M157K
IIGGEFTTIENQPWYAAIYWQERGGSEWHRCGGSLISPCWVISATHCFIDQPLKEDYVVYLGRSRLNSNTQGEMKFEVENLILHKDYSADEAAQHNDIALLKIRSKEGRCAQPSRTIQTISLPSMYNDPQFGTSCEITGFGKENSTDKLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 263 - protein, 253 aa, synthetic construct
  REGION 1..253: note = UROKINASE-TYPE PLASMINOGEN ACTIVATOR (u-PA) protease domain F30Y/R35W/R36A/H37E/V38E/T39W/Y40H/V41R/Y60bQ/K61D /I65R/T97aE/L97bA/H99Q/C122S/Y149K/M157K
IIGGEFTTIENQPWYAAIYWAERGGSEWHRCGGSLISPCWVISATHCFIDQPDKEDYRVYLGRSRLNSNTQGEMKFEVENLILHKDYSADEAAQHNDIALLKIRSKEGRCAQPSRTIQTISLPSMYNDPQFGTSCEITGFGKENSTDKLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 264 - protein, 253 aa, synthetic construct
  REGION 1..253: note = UROKINASE-TYPE PLASMINOGEN ACTIVATOR (u-PA) protease domain F30Y/R35W/R36K/H37E/V38E/T39W/Y40H/V41R/Y60bQ/K61E /I65T/T97aE/L97bA/H99Q/C122S/Y149K/M157K
IIGGEFTTIENQPWYAAIYWKERGGSEWHRCGGSLISPCWVISATHCFIDQPEKEDYTVYLGRSRLNSNTQGEMKFEVENLILHKDYSADEAAQHNDIALLKIRSKEGRCAQPSRTIQTISLPSMYNDPQFGTSCEITGFGKENSTDKLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 265 - protein, 253 aa, synthetic construct
  REGION 1..253: note = UROKINASE-TYPE PLASMINOGEN ACTIVATOR (u-PA) protease domain F30Y/R35W/R36H/H37E/V38E/T39Y/Y40F/V41R/Y60bQ/T97a E/L97bA/H99Q/C122S/Y149R/M157K
IIGGEFTTIENQPWYAAIYWHERGGSEYFRCGGSLISPCWVISATHCFIDQPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 266 - protein, 253 aa, synthetic construct
  REGION 1..253: note = UROKINASE-TYPE PLASMINOGEN ACTIVATOR (u-PA) protease domain F30Y/R35W/R36H/H37E/V38E/T39W/Y40H/V41R/Y60bQ/T97a E/L97bA/H99Q/C122S/Y149K/M157K/Q192P
IIGGEFTTIENQPWYAAIYWHERGGSEWHRCGGSLISPCWVISATHCFIDQPKKEDYIVYLGRSRLNSNTQGEMKFEVENLILHKDYSADEAAQHNDIALLKIRSKEGRCAQPSRTIQTISLPSMYNDPQFGTSCEITGFGKENSTDKLYPEQLKKTVVKLISHRECQQPHYYGSEVTTKMLCAADPQWKTDSCPGDSGGPLVCSLQGRMTLTGIVSWGRGCALKDKPGVYTRVSHFLPWIRSHTKEENGLAL

SEQ ID NO: 267 - protein, 253 aa, synthetic construct
  REGION 1..253: note = UROKINASE-TYPE PLASMINOGEN ACTIVATOR (u-PA) protease domain V38E/Y40Q/V41Q/D60aP/Y60bL/L97bA/H99Q/C122S/Y149W
IIGGEFTTIENQPWFAAIYRRHRGGSETQQCGGSLISPCWVISATHCFIPLPKKEDYIVYLGRSRLNSNTQGEMKFEVENLILHKDYSADTAAQHNDIALLKIRSKEGRCAQPSRTIQTISLPSMYNDPQFGTSCEITGFGKENSTDWLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 268 - protein, 253 aa, synthetic construct
  REGION 1..253: note = UROKINASE-TYPE PLASMINOGEN ACTIVATOR (u-PA) protease domain V38E/Y40Q/V41L/D60aP/Y60bL/L97bA/H99Q/C122S/Y149W
IIGGEFTTIENQPWFAAIYRRHRGGSETQLCGGSLISPCWVISATHCFIPLPKKEDYIVYLGRSRLNSNTQGEMKFEVENLILHKDYSADTAAQHNDIALLKIRSKEGRCAQPSRTIQTISLPSMYNDPQFGTSCEITGFGKENSTDWLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 269 - protein, 253 aa, synthetic construct
  REGION 1..253: note = UROKINASE-TYPE PLASMINOGEN ACTIVATOR (u-PA) protease domain F30Y/R35W/R36H/H37E/V38E/T39W/Y40H/V41R/Y60bQ/T97a E/L97bA/H99L/C122S/Y149K/M157K
IIGGEFTTIENQPWYAAIYWHERGGSEWHRCGGSLISPCWVISATHCFIDQPKKEDYIVYLGRSRLNSNTQGEMKFEVENLILHKDYSADEAALHNDIALLKIRSKEGRCAQPSRTIQTISLPSMYNDPQFGTSCEITGFGKENSTDKLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 270 - protein, 253 aa, synthetic construct
  REGION 1..253: note = UROKINASE-TYPE PLASMINOGEN ACTIVATOR (u-PA) protease domain F30Y/R36H/V38E/Y40H/V41R/T97aE/L97bA/H99Q/C122S/M1 57K
IIGGEFTTIENQPWYAAIYRHHRGGSETHRCGGSLISPCWVISATHCFIDYPKKEDYIVYLGRSRLNSNTQGEMKFEVENLILHKDYSADEAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 271 - protein, 253 aa, synthetic construct
  REGION 1..253: note = UROKINASE-TYPE PLASMINOGEN ACTIVATOR (u-PA) protease domain R35Y/R36H/H37K/V38E/T39F/V41R/T97aI/L97bA/H99Q/C12 2S/Y149R/M157K
IIGGEFTTIENQPWFAAIYYHKRGGSEFYRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 272 - protein, 253 aa, synthetic construct
  REGION 1..253: note = UROKINASE-TYPE PLASMINOGEN ACTIVATOR (u-PA) protease domain F30Y/R35Y/R36H/H37K/V38E/T39F/Y40F/V41R/T97aI/L97b A/H99Q/C122S/M157K
IIGGEFTTIENQPWYAAIYYHKRGGSEFFRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 273 - protein, 253 aa, synthetic construct
  REGION 1..253: note = UROKINASE-TYPE PLASMINOGEN ACTIVATOR (u-PA) protease domain F30Y/R36H/V38E/Y40H/V41R/T97aE/L97bA/H99Q/C122S/Y1 49R/M157K
IIGGEFTTIENQPWYAAIYRHHRGGSETHRCGGSLISPCWVISATHCFIDYPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 274 - protein, 253 aa, synthetic construct
  REGION 1..253: note = UROKINASE-TYPE PLASMINOGEN ACTIVATOR (u-PA) protease domain L97bA/H99Q/C122S
IIGGEFTTIENQPWFAAIYRRHRGGSVTYVCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 275 - protein, 253 aa, synthetic construct
  REGION 1..253: note = UROKINASE-TYPE PLASMINOGEN ACTIVATOR (u-PA) protease domain F30Y/R35Y/R36H/H37K/V38E/T39F/Y40F/V41R/T97aI/L97b A/H99Q/Y149R/M157K
IIGGEFTTIENQPWYAAIYYHKRGGSEFFRCGGSLISPCWVISATHCFIDYPKKEDYIVYLGRSRLNSNTQGEMKFEVENLILHKDYSADIAAQHNDIALLKIRSKEGRCAQPSRTIQTICLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 276 - protein, 253 aa, synthetic construct
  REGION 1..253: note = UROKINASE-TYPE PLASMINOGEN ACTIVATOR (u-PA) protease domain F30Y/R35Y/R36H/H37K/V38E/T39F/Y40F/V41R/K61R/K62R/ T97aI/L97bA/H99Q/C122S/Y149R/M157K
IIGGEFTTIENQPWYAAIYYHKRGGSEFFRCGGSLISPCWVISATHCFIDYPRREDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 277 - protein, 253 aa, synthetic construct
  REGION 1..253: note = UROKINASE-TYPE PLASMINOGEN ACTIVATOR (u-PA) protease domain F30Y/R35Y/R36H/H37K/V38E/T39F/Y40F/V41R/K82R/T97aI /L97bA/H99Q/K110aR/C122S/Y149R/M157K
IIGGEFTTIENQPWYAAIYYHKRGGSEFFRCGGSLISPCWVISATHCFIDYPKKEDYIVYLGRSRLNSNTQGEMRFEVENLILHKDYSADIAAQHNDIALLKIRSREGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 278 - protein, 253 aa, synthetic construct
  REGION 1..253: note = UROKINASE-TYPE PLASMINOGEN ACTIVATOR (u-PA) protease domain F30Y/R35Y/R36H/H37K/V38E/T39F/Y40F/V41R/K92R/T97aI /L97bA/H99Q/C122S/Y149R/M157K
IIGGEFTTIENQPWYAAIYYHKRGGSEFFRCGGSLISPCWVISATHCFIDYPKKEDYIVYLGRSRLNSNTQGEMKFEVENLILHRDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 279 - protein, 253 aa, synthetic construct
  REGION 1..253: note = UROKINASE-TYPE PLASMINOGEN ACTIVATOR (u-PA) protease domain F30Y/R35Y/R36H/H37K/V38E/T39F/Y40F/V41R/K92S/T97aI /L97bA/H99Q/C122S/Y149R/M157K
IIGGEFTTIENQPWYAAIYYHKRGGSEFFRCGGSLISPCWVISATHCFIDYPKKEDYIVYLGRSRLNSNTQGEMKFEVENLILHSDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 280 - protein, 253 aa, synthetic construct
  REGION 1..253: note = UROKINASE-TYPE PLASMINOGEN ACTIVATOR (u-PA) protease domain F30Y/R35Y/R36H/H37K/V38E/T39F/Y40F/V41R/T97aI/L97b A/H99Q/C122S/Y149R/M157K/K179R
IIGGEFTTIENQPWYAAIYYHKRGGSEFFRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTRMLCAADPQWKTDSCQGDSGGPLVCSLQGRMTLTGIVSWGRGCALKDKPGVYTRVSHFLPWIRSHTKEENGLAL

SEQ ID NO: 281 - protein, 253 aa, synthetic construct
  REGION 1..253: note = UROKINASE-TYPE PLASMINOGEN ACTIVATOR (u-PA) protease domain F30Y/R35Y/R36H/H37K/V38E/T39F/Y40F/V41R/T97aI/L97b A/H99Q/C122S/Y149R/M157K/K179S
IIGGEFTTIENQPWYAAIYYHKRGGSEFFRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTSMLCAADPQWKTDSCQGDSGGPLVCSLQGRMTLTGIVSWGRGCALKDKPGVYTRVSHFLPWIRSHTKEENGLAL

SEQ ID NO: 282 - protein, 253 aa, synthetic construct
  REGION 1..253: note = UROKINASE-TYPE PLASMINOGEN ACTIVATOR (u-PA) protease domain F30Y/R35Y/R36H/H37K/V38E/T39F/Y40F/V41R/T97aI/L97b A/H99Q/C122S/Y149R/M157K/K187S/K223S/K224Y
IIGGEFTTIENQPWYAAIYYHKRGGSEFFRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWSTDSCQGDSGGPLVCSLQGRMTLTGIVSWGRGCALSDYPGVYTRVSHFLPWIRSHTKEENGLAL

SEQ ID NO: 283 - protein, 253 aa, synthetic construct
  REGION 1..253: note = UROKINASE-TYPE PLASMINOGEN ACTIVATOR (u-PA) protease domain F30Y/R35W/R36H/H37S/V38E/T39Y/Y40H/V41R/Y60bN/T97a E/L97bA/H99Q/C122S/M157K
IIGGEFTTIENQPWYAAIYWHSRGGSEYHRCGGSLISPCWVISATHCFIDNPKKEDYIVYLGRSRLNSNTQGEMKFEVENLILHKDYSADEAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 284 - protein, 253 aa, synthetic construct
  REGION 1..253: note = UROKINASE-TYPE PLASMINOGEN ACTIVATOR (u-PA) protease domain F30Y/R35W/R36H/H37S/V38E/T39Y/Y40H/V41R/Y60bN/T97a E/L97bA/H99Q/C122S
IIGGEFTTIENQPWYAAIYWHSRGGSEYHRCGGSLISPCWVISATHCFIDNPKKEDYIVYLGRSRLNSNTQGEMKFEVENLILHKDYSADEAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 285 - protein, 253 aa, synthetic construct
  REGION 1..253: note = UROKINASE-TYPE PLASMINOGEN ACTIVATOR (u-PA) protease domain F30Y/R35W/H37S/V38E/T39Y/Y40H/V41R/Y60bN/T97aE/L97 bA/H99Q/C122S/Y149R
IIGGEFTTIENQPWYAAIYWRSRGGSEYHRCGGSLISPCWVISATHCFIDNPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 286 - protein, 253 aa, synthetic construct
  REGION 1..253: note = UROKINASE-TYPE PLASMINOGEN ACTIVATOR (u-PA) protease domain F30Y/R35W/H37S/V38E/T39Y/Y40H/V41R/Y60bN/T97aE/L97 bA/H99Q/C122S/M157K
IIGGEFTTIENQPWYAAIYWRSRGGSEYHRCGGSLISPCWVISATHCFIDNPKKEDYIVYLGRSRLNSNTQGEMKFEVENLILHKDYSADEAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 287 - protein, 253 aa, synthetic construct
  REGION 1..253: note = UROKINASE-TYPE PLASMINOGEN ACTIVATOR (u-PA) protease domain F30Y/R35Y/R36H/H37K/V38E/T39F/Y40F/V41R/K61S/K62S/ T97aI/L97bA/H99Q/C122S/Y149R/M157K
IIGGEFTTIENQPWYAAIYYHKRGGSEFFRCGGSLISPCWVISATHCFIDYPSSEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 288 - protein, 253 aa, synthetic construct
  REGION 1..253: note = UROKINASE-TYPE PLASMINOGEN ACTIVATOR (u-PA) protease domain F30Y/R35Y/R36H/H37K/V38E/T39F/Y40F/V41R/K82S/T97aI /L97bA/H99Q/K110aS/C122S/Y149R/M157K
IIGGEFTTIENQPWYAAIYYHKRGGSEFFRCGGSLISPCWVISATHCFIDYPKKEDYIVYLGRSRLNSNTQGEMSFEVENLILHKDYSADIAAQHNDIALLKIRSSEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 289 - protein, 253 aa, synthetic construct
  REGION 1..253: note = UROKINASE-TYPE PLASMINOGEN ACTIVATOR (u-PA) protease domain F30Y/R35Y/R36H/H37K/V38E/T39F/Y40F/V41R/T97aI/L97b A/H99Q/C122S/Y149R/M157K/K187R/K223R/K224R
IIGGEFTTIENQPWYAAIYYHKRGGSEFFRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWRTDSCQGDSGGPLVCSLQGRMTLTGIVSWGRGCALRDRPGVYTRVSHFLPWIRSHTKEENGLAL

SEQ ID NO: 290 - protein, 253 aa, synthetic construct
  REGION 1..253: note = UROKINASE-TYPE PLASMINOGEN ACTIVATOR (u-PA) protease domain F30Y/R35W/H37S/V38E/T39Y/Y40H/V41R/Y60bN/T97aE/L97 bA/H99Q/C122S
IIGGEFTTIENQPWYAAIYWRSRGGSEYHRCGGSLISPCWVISATHCFIDNPKKEDYIVYLGRSRLNSNTQGEMKFEVENLILHKDYSADEAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 291 - protein, 253 aa, synthetic construct
  REGION 1..253: note = UROKINASE-TYPE PLASMINOGEN ACTIVATOR (u-PA) protease domain R35W/H37P/R37aN/V38E/T39Y/V41R/D60aP/Y60bL/T97aI/L 97bA/H99Q/C122S
IIGGEFTTIENQPWFAAIYWRPNGGSEYYRCGGSLISPCWVISATHCFIPLPKKEDYIVYLGRSRLNSNTQGEMKFEVENLILHKDYSADIAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 292 - protein, 253 aa, synthetic construct
  REGION 1..253: note = UROKINASE-TYPE PLASMINOGEN ACTIVATOR (u-PA) protease domain F30Y/R35W/R36H/H37S/V38E/T39Y/Y40F/V41R/Y60bN/T97a E/L97bA/H99Q/C122S/Y149R/M157K
IIGGEFTTIENQPWYAAIYWHSRGGSEYFRCGGSLISPCWVISATHCFIDNPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 293 - protein, 253 aa, synthetic construct
  REGION 1..253: note = UROKINASE-TYPE PLASMINOGEN ACTIVATOR (u-PA) protease domain V38E/V41R/T97aI/L97bA/H99Q/C122S
IIGGEFTTIENQPWFAAIYRRHRGGSETYRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 294 - protein, 253 aa, synthetic construct
  REGION 1..253: note = UROKINASE-TYPE PLASMINOGEN ACTIVATOR (u-PA) protease domain V38E/T97aE/L97bA/H99Q/C122S
IIGGEFTTIENQPWFAAIYRRHRGGSETYVCGGSLISPCWVISATHCFIDYPKKEDYIVYLGRSRLNSNTQGEMKFEVENLILHKDYSADEAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 295 - protein, 253 aa, synthetic construct
  REGION 1..253: note = UROKINASE-TYPE PLASMINOGEN ACTIVATOR (u-PA) protease domain V38E/T97aI/L97bA/H99Q/C122S
IIGGEFTTIENQPWFAAIYRRHRGGSETYVCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 296 - protein, 253 aa, synthetic construct
  REGION 1..253: note = UROKINASE-TYPE PLASMINOGEN ACTIVATOR (u-PA) protease domain V38D/L97bR/H99E/C122S/E175D
IIGGEFTTIENQPWFAAIYRRHRGGSDTYVCGGSLISPCWVISATHCFIDYPKKEDYIVYLGRSRLNSNTQGEMKFEVENLILHKDYSADTRAEHNDIALLKIRSKEGRCAQPSRTIQTISLPSMYNDPQFGTSCEITGFGKENSTDYLYPEQLKMTVVKLISHRECQQPHYYGSDVTTKMLCAADPQWKTDSCQGDSGGPLVCSLQGRMTLTGIVSWGRGCALKDKPGVYTRVSHFLPWIRSHTKEENGLAL

SEQ ID NO: 297 - protein, 253 aa, synthetic construct
  REGION 1..253: note = UROKINASE-TYPE PLASMINOGEN ACTIVATOR (u-PA) protease domain V38D/L97bR/H99E/C122S/E175D/R217E
IIGGEFTTIENQPWFAAIYRRHRGGSDTYVCGGSLISPCWVISATHCFIDYPKKEDYIVYLGRSRLNSNTQGEMKFEVENLILHKDYSADTRAEHNDIALLKIRSKEGRCAQPSRTIQTISLPSMYNDPQFGTSCEITGFGKENSTDYLYPEQLKMTVVKLISHRECQQPHYYGSDVTTKMLCAADPQWKTDSCQGDSGGPLVCSLQGRMTLTGIVSWGEGCALKDKPGVYTRVSHFLPWIRSHTKEENGLAL

SEQ ID NO: 298 - protein, 253 aa, synthetic construct
  REGION 1..253: note = UROKINASE-TYPE PLASMINOGEN ACTIVATOR (u-PA) protease domain V38D/L97bR/H99E/C122S/E175D/K224R
IIGGEFTTIENQPWFAAIYRRHRGGSDTYVCGGSLISPCWVISATHCFIDYPKKEDYIVYLGRSRLNSNTQGEMKFEVENLILHKDYSADTRAEHNDIALLKIRSKEGRCAQPSRTIQTISLPSMYNDPQFGTSCEITGFGKENSTDYLYPEQLKMTVVKLISHRECQQPHYYGSDVTTKMLCAADPQWKTDSCQGDSGGPLVCSLQGRMTLTGIVSWGRGCALKDRPGVYTRVSHFLPWIRSHTKEENGLAL

SEQ ID NO: 299 - protein, 253 aa, synthetic construct
  REGION 1..253: note = UROKINASE-TYPE PLASMINOGEN ACTIVATOR (u-PA) protease domain R35Q/H37Y/R37aE/V38D/T39Y/V41R/D60aP/Y60bQ/T97aI/L 97bA/H99Q/C122S/Y149R
IIGGEFTTIENQPWFAAIYQRYEGGSDYYRCGGSLISPCWVISATHCFIPQPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 300 - protein, 253 aa, synthetic construct
  REGION 1..253: note = UROKINASE-TYPE PLASMINOGEN ACTIVATOR (u-PA) protease domain R35Q/H37Y/V38E/T39Y/V41R/D60aP/T97aI/L97bA/H99Q/C1 22S/Y149R
IIGGEFTTIENQPWFAAIYQRYRGGSEYYRCGGSLISPCWVISATHCFIPYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 301 - protein, 253 aa, synthetic construct
  REGION 1..253: note = UROKINASE-TYPE PLASMINOGEN ACTIVATOR (u-PA) protease domain V38E/V41L/Y60bL/L97bA/H99Q/C122S
IIGGEFTTIENQPWFAAIYRRHRGGSETYLCGGSLISPCWVISATHCFIDLPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 302 - protein, 253 aa, synthetic construct
  REGION 1..253: note = UROKINASE-TYPE PLASMINOGEN ACTIVATOR (u-PA) protease domain L97bG/H99Q/C122S/R217Q
IIGGEFTTIENQPWFAAIYRRHRGGSVTYVCGGSLISPCWVISATHCFIDYPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGQGCALKDKPGVYTRVSHFLPWIRSHTKEENGLAL

SEQ ID NO: 303 - protein, 253 aa, synthetic construct
  REGION 1..253: note = UROKINASE-TYPE PLASMINOGEN ACTIVATOR (u-PA) protease domain V38D/H99Q/C122S/R217Q
IIGGEFTTIENQPWFAAIYRRHRGGSDTYVCGGSLISPCWVISATHCFIDYPKKEDYIVYLGRSRLNSNTQGEMKFEVENLILHKDYSADTLAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGQGCALKDKPGVYTRVSHFLPWIRSHTKEENGLAL

SEQ ID NO: 304 - protein, 253 aa, synthetic construct
  REGION 1..253: note = UROKINASE-TYPE PLASMINOGEN ACTIVATOR (u-PA) protease domain V38D/L97bG/C122S/R217Q
IIGGEFTTIENQPWFAAIYRRHRGGSDTYVCGGSLISPCWVISATHCFIDYPKKEDYIVYLGRSRLNSNTQGEMKFEVENLILHKDYSADTGAHHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGQGCALKDKPGVYTRVSHFLPWIRSHTKEENGLAL

SEQ ID NO: 305 - protein, 253 aa, synthetic construct
  REGION 1..253: note = UROKINASE-TYPE PLASMINOGEN ACTIVATOR (u-PA) protease domain V38D/L97bG/H99Q/C122S
IIGGEFTTIENQPWFAAIYRRHRGGSDTYVCGGSLISPCWVISATHCFIDYPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 306 - protein, 253 aa, synthetic construct
  REGION 1..253: note = UROKINASE-TYPE PLASMINOGEN ACTIVATOR (u-PA) protease domain V38D/L97bG/H99Q/C122S/S195A/R217Q
IIGGEFTTIENQPWFAAIYRRHRGGSDTYVCGGSLISPCWVISATHCFIDYPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDAGGPLVCSLQGRMTLTGIVSWGQGCALKDKPGVYTRVSHFLPWIRSHTKEENGLAL

SEQ ID NO: 307 - protein, 253 aa, synthetic construct
  REGION 1..253: note = UROKINASE-TYPE PLASMINOGEN ACTIVATOR (u-PA) protease domain Y40Q/Y60bL/L97bA/H99Q/C122S
IIGGEFTTIENQPWFAAIYRRHRGGSVTQVCGGSLISPCWVISATHCFIDLPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 308 - protein, 253 aa, synthetic construct
  REGION 1..253: note = UROKINASE-TYPE PLASMINOGEN ACTIVATOR (u-PA) protease domain V38E/Y40Q/L97bA/H99Q/C122S
IIGGEFTTIENQPWFAAIYRRHRGGSETQVCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 309 - protein, 253 aa, synthetic construct
  REGION 1..253: note = UROKINASE-TYPE PLASMINOGEN ACTIVATOR (u-PA) protease domain V38E/Y40Q/V41L/L97bA/C122S
IIGGEFTTIENQPWFAAIYRRHRGGSETQLCGGSLISPCWVISATHCFIDYPKKEDYIVYLGRSRLNSNTQGEMKFEVENLILHKDYSADTAAHHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 310 - protein, 253 aa, synthetic construct
  REGION 1..253: note = UROKINASE-TYPE PLASMINOGEN ACTIVATOR (u-PA) protease domain Y40Q/L97bA/H99Q/C122S
IIGGEFTTIENQPWFAAIYRRHRGGSVTQVCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 311 - protein, 253 aa, synthetic construct
  REGION 1..253: note = UROKINASE-TYPE PLASMINOGEN ACTIVATOR (u-PA) protease domain T39L/Y40L/V41R/T97aI/L97bA/H99Q/C122S
IIGGEFTTIENQPWFAAIYRRHRGGSVLLRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 312 - protein, 253 aa, synthetic construct
  REGION 1..253: note = UROKINASE-TYPE PLASMINOGEN ACTIVATOR (u-PA) protease domain V38D/Y40L/V41R/T97aI/L97bA/H99Q/C122S
IIGGEFTTIENQPWFAAIYRRHRGGSDTLRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 313 - protein, 253 aa, synthetic construct
  REGION 1..253: note = UROKINASE-TYPE PLASMINOGEN ACTIVATOR (u-PA) protease domain V38D/T39L/V41R/T97aI/L97bA/H99Q/C122S
IIGGEFTTIENQPWFAAIYRRHRGGSDLYRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 314 - protein, 253 aa, synthetic construct
  REGION 1..253: note = UROKINASE-TYPE PLASMINOGEN ACTIVATOR (u-PA) protease domain V38D/T39L/Y40L/T97aI/L97bA/H99Q/C122S
IIGGEFTTIENQPWFAAIYRRHRGGSDLLVCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 315 - protein, 253 aa, synthetic construct
  REGION 1..253: note = UROKINASE-TYPE PLASMINOGEN ACTIVATOR (u-PA) protease domain V38D/T39L/Y40L/V41R/L97bA/H99Q/C122S
IIGGEFTTIENQPWFAAIYRRHRGGSDLLRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 316 - protein, 253 aa, synthetic construct
  REGION 1..253: note = UROKINASE-TYPE PLASMINOGEN ACTIVATOR (u-PA) protease domain V38D/T39L/Y40L/V41R/T97aI/H99Q/C122S
IIGGEFTTIENQPWFAAIYRRHRGGSDLLRCGGSLISPCWVISATHCFIDYPKKEDYIVYLGRSRLNSNTQGEMKFEVENLILHKDYSADILAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 317 - protein, 253 aa, synthetic construct
  REGION 1..253: note = UROKINASE-TYPE PLASMINOGEN ACTIVATOR (u-PA) protease domain V38D/L97bR/H99Q/C122S/Y151L/R217V
IIGGEFTTIENQPWFAAIYRRHRGGSDTYVCGGSLISPCWVISATHCFIDYPKKEDYIVYLGRSRLNSNTQGEMKFEVENLILHKDYSADTRAQHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCQGDSGGPLVCSLQGRMTLTGIVSWGVGCALKDKPGVYTRVSHFLPWIRSHTKEENGLAL

SEQ ID NO: 318 - protein, 253 aa, synthetic construct
  REGION 1..253: note = UROKINASE-TYPE PLASMINOGEN ACTIVATOR (u-PA) protease domain V38D/V41R/L97bR/H99Q/C122S/R217V
IIGGEFTTIENQPWFAAIYRRHRGGSDTYRCGGSLISPCWVISATHCFIDYPKKEDYIVYLGRSRLNSNTQGEMKFEVENLILHKDYSADTRAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGVGCALKDKPGVYTRVSHFLPWIRSHTKEENGLAL

SEQ ID NO: 319 - protein, 253 aa, synthetic construct
  REGION 1..253: note = UROKINASE-TYPE PLASMINOGEN ACTIVATOR (u-PA) protease domain V38D/Y40L/V41K/L97bR/H99L/C122S/E175D
IIGGEFTTIENQPWFAAIYRRHRGGSDTLKCGGSLISPCWVISATHCFIDYPKKEDYIVYLGRSRLNSNTQGEMKFEVENLILHKDYSADTRALHNDIALLKIRSKEGRCAQPSRTIQTISLPSMYNDPQFGTSCEITGFGKENSTDYLYPEQLKMTVVKLISHRECQQPHYYGSDVTTKMLCAADPQWKTDSCQGDSGGPLVCSLQGRMTLTGIVSWGRGCALKDKPGVYTRVSHFLPWIRSHTKEENGLAL

SEQ ID NO: 320 - protein, 253 aa, synthetic construct
  REGION 1..253: note = UROKINASE-TYPE PLASMINOGEN ACTIVATOR (u-PA) protease domain V38D/T39L/Y40L/V41K/L97bR/H99L/C122S/E175D
IIGGEFTTIENQPWFAAIYRRHRGGSDLLKCGGSLISPCWVISATHCFIDYPKKEDYIVYLGRSRLNSNTQGEMKFEVENLILHKDYSADTRALHNDIALLKIRSKEGRCAQPSRTIQTISLPSMYNDPQFGTSCEITGFGKENSTDYLYPEQLKMTVVKLISHRECQQPHYYGSDVTTKMLCAADPQWKTDSCQGDSGGPLVCSLQGRMTLTGIVSWGRGCALKDKPGVYTRVSHFLPWIRSHTKEENGLAL

SEQ ID NO: 321 - protein, 253 aa, synthetic construct
  REGION 1..253: note = UROKINASE-TYPE PLASMINOGEN ACTIVATOR (u-PA) protease domain V38D/T39L/Y40L/V41R/T97aI/L97bA/C122S
IIGGEFTTIENQPWFAAIYRRHRGGSDLLRCGGSLISPCWVISATHCFIDYPKKEDYIVYLGRSRLNSNTQGEMKFEVENLILHKDYSADIAAHHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 322 - protein, 253 aa, synthetic construct
  REGION 1..253: note = UROKINASE-TYPE PLASMINOGEN ACTIVATOR (u-PA) protease domain V38D/V41R/L97bR/H99Q/C122S/Y151L
IIGGEFTTIENQPWFAAIYRRHRGGSDTYRCGGSLISPCWVISATHCFIDYPKKEDYIVYLGRSRLNSNTQGEMKFEVENLILHKDYSADTRAQHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 323 - protein, 253 aa, synthetic construct
  REGION 1..253: note = UROKINASE-TYPE PLASMINOGEN ACTIVATOR (u-PA) protease domain R37aD/G37bD/V38F/T39H/V41R/Y60bK/T97aS/L97bR/H99E/ C122S/Y151L/E175D/Q192T/R217E/K224R
IIGGEFTTIENQPWFAAIYRRHDDGSFHYRCGGSLISPCWVISATHCFIDKPKKEDYIVYLGRSRLNSNTQGEMKFEVENLILHKDYSADSRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDRPGVYTRVSHFLPWIRSHTKEENGLAL

SEQ ID NO: 324 - protein, 253 aa, synthetic construct
  REGION 1..253: note = UROKINASE-TYPE PLASMINOGEN ACTIVATOR (u-PA) protease domain H37G/G37bD/V38F/T39H/V41R/Y60bK/T97aS/L97bR/H99E/C 122S/Y151L/E175D/Q192T/R217E/K224R
IIGGEFTTIENQPWFAAIYRRGRDGSFHYRCGGSLISPCWVISATHCFIDKPKKEDYIVYLGRSRLNSNTQGEMKFEVENLILHKDYSADSRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDRPGVYTRVSHFLPWIRSHTKEENGLAL

SEQ ID NO: 325 - protein, 253 aa, synthetic construct
  REGION 1..253: note = UROKINASE-TYPE PLASMINOGEN ACTIVATOR (u-PA) protease domain H37G/R37aD/V38F/T39H/V41R/Y60bK/T97aS/L97bR/H99E/C 122S/Y151L/E175D/Q192T/R217E/K224R
IIGGEFTTIENQPWFAAIYRRGDGGSFHYRCGGSLISPCWVISATHCFIDKPKKEDYIVYLGRSRLNSNTQGEMKFEVENLILHKDYSADSRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDRPGVYTRVSHFLPWIRSHTKEENGLAL

SEQ ID NO: 326 - protein, 253 aa, synthetic construct
  REGION 1..253: note = UROKINASE-TYPE PLASMINOGEN ACTIVATOR (u-PA) protease domain H37G/R37aD/G37bD/T39H/V41R/Y60bK/T97aS/L97bR/H99E/ C122S/Y151L/E175D/Q192T/R217E/K224R
IIGGEFTTIENQPWFAAIYRRGDDGSVHYRCGGSLISPCWVISATHCFIDKPKKEDYIVYLGRSRLNSNTQGEMKFEVENLILHKDYSADSRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDRPGVYTRVSHFLPWIRSHTKEENGLAL

SEQ ID NO: 327 - protein, 253 aa, synthetic construct
  REGION 1..253: note = UROKINASE-TYPE PLASMINOGEN ACTIVATOR (u-PA) protease domain H37G/R37aD/G37bD/V38F/V41R/Y60bK/T97aS/L97bR/H99E/ C122S/Y151L/E175D/Q192T/R217E/K224R
IIGGEFTTIENQPWFAAIYRRGDDGSFTYRCGGSLISPCWVISATHCFIDKPKKEDYIVYLGRSRLNSNTQGEMKFEVENLILHKDYSADSRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDRPGVYTRVSHFLPWIRSHTKEENGLAL

SEQ ID NO: 328 - protein, 253 aa, synthetic construct
  REGION 1..253: note = UROKINASE-TYPE PLASMINOGEN ACTIVATOR (u-PA) protease domain H37G/R37aD/G37bD/V38F/T39H/Y60bK/T97aS/L97bR/H99E/ C122S/Y151L/E175D/Q192T/R217E/K224R
IIGGEFTTIENQPWFAAIYRRGDDGSFHYVCGGSLISPCWVISATHCFIDKPKKEDYIVYLGRSRLNSNTQGEMKFEVENLILHKDYSADSRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDRPGVYTRVSHFLPWIRSHTKEENGLAL

SEQ ID NO: 329 - protein, 253 aa, synthetic construct
  REGION 1..253: note = UROKINASE-TYPE PLASMINOGEN ACTIVATOR (u-PA) protease domain H37G/R37aD/G37bD/V38F/T39H/V41R/T97aS/L97bR/H99E/C 122S/Y151L/E175D/Q192T/R217E/K224R
IIGGEFTTIENQPWFAAIYRRGDDGSFHYRCGGSLISPCWVISATHCFIDYPKKEDYIVYLGRSRLNSNTQGEMKFEVENLILHKDYSADSRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDRPGVYTRVSHFLPWIRSHTKEENGLAL

SEQ ID NO: 330 - protein, 253 aa, synthetic construct
  REGION 1..253: note = UROKINASE-TYPE PLASMINOGEN ACTIVATOR (u-PA) protease domain H37G/R37aD/G37bD/V38F/T39H/V41R/Y60bK/L97bR/H99E/C 122S/Y151L/E175D/Q192T/R217E/K224R
IIGGEFTTIENQPWFAAIYRRGDDGSFHYRCGGSLISPCWVISATHCFIDKPKKEDYIVYLGRSRLNSNTQGEMKFEVENLILHKDYSADTRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDRPGVYTRVSHFLPWIRSHTKEENGLAL

SEQ ID NO: 331 - protein, 253 aa, synthetic construct
  REGION 1..253: note = UROKINASE-TYPE PLASMINOGEN ACTIVATOR (u-PA) protease domain H37G/R37aD/G37bD/V38F/T39H/V41R/Y60bK/T97aS/H99E/C 122S/Y151L/E175D/Q192T/R217E/K224R
IIGGEFTTIENQPWFAAIYRRGDDGSFHYRCGGSLISPCWVISATHCFIDKPKKEDYIVYLGRSRLNSNTQGEMKFEVENLILHKDYSADSLAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDRPGVYTRVSHFLPWIRSHTKEENGLAL

SEQ ID NO: 332 - protein, 253 aa, synthetic construct
  REGION 1..253: note = UROKINASE-TYPE PLASMINOGEN ACTIVATOR (u-PA) protease domain H37G/R37aD/G37bD/V38F/T39H/V41R/Y60bK/T97aS/L97bR/ C122S/Y151L/E175D/Q192T/R217E/K224R
IIGGEFTTIENQPWFAAIYRRGDDGSFHYRCGGSLISPCWVISATHCFIDKPKKEDYIVYLGRSRLNSNTQGEMKFEVENLILHKDYSADSRAHHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDRPGVYTRVSHFLPWIRSHTKEENGLAL

SEQ ID NO: 333 - protein, 253 aa, synthetic construct
  REGION 1..253: note = UROKINASE-TYPE PLASMINOGEN ACTIVATOR (u-PA) protease domain H37G/R37aD/G37bD/V38F/T39H/V41R/Y60bK/T97aS/L97bR/ H99E/C122S/E175D/Q192T/R217E/K224R
IIGGEFTTIENQPWFAAIYRRGDDGSFHYRCGGSLISPCWVISATHCFIDKPKKEDYIVYLGRSRLNSNTQGEMKFEVENLILHKDYSADSRAEHNDIALLKIRSKEGRCAQPSRTIQTISLPSMYNDPQFGTSCEITGFGKENSTDYLYPEQLKMTVVKLISHRECQQPHYYGSDVTTKMLCAADPQWKTDSCTGDSGGPLVCSLQGRMTLTGIVSWGEGCALKDRPGVYTRVSHFLPWIRSHTKEENGLAL

SEQ ID NO: 334 - protein, 253 aa, synthetic construct
  REGION 1..253: note = UROKINASE-TYPE PLASMINOGEN ACTIVATOR (u-PA) protease domain H37G/R37aD/G37bD/V38F/T39H/V41R/Y60bK/T97aS/L97bR/ H99E/C122S/Y151L/Q192T/R217E/K224R
IIGGEFTTIENQPWFAAIYRRGDDGSFHYRCGGSLISPCWVISATHCFIDKPKKEDYIVYLGRSRLNSNTQGEMKFEVENLILHKDYSADSRAEHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCTGDSGGPLVCSLQGRMTLTGIVSWGEGCALKDRPGVYTRVSHFLPWIRSHTKEENGLAL

SEQ ID NO: 335 - protein, 253 aa, synthetic construct
  REGION 1..253: note = UROKINASE-TYPE PLASMINOGEN ACTIVATOR (u-PA) protease domain H37G/R37aD/G37bD/V38F/T39H/V41R/Y60bK/T97aS/L97bR/ H99E/C122S/Y151L/E175D/R217E/K224R
IIGGEFTTIENQPWFAAIYRRGDDGSFHYRCGGSLISPCWVISATHCFIDKPKKEDYIVYLGRSRLNSNTQGEMKFEVENLILHKDYSADSRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCQGDSGGPLVCSLQGRMTLTGIVSWGEGCALKDRPGVYTRVSHFLPWIRSHTKEENGLAL

SEQ ID NO: 336 - protein, 253 aa, synthetic construct
  REGION 1..253: note = UROKINASE-TYPE PLASMINOGEN ACTIVATOR (u-PA) protease domain H37G/R37aD/G37bD/V38F/T39H/V41R/Y60bK/T97aS/L97bR/ H99E/C122S/Y151L/E175D/Q192T/K224R
IIGGEFTTIENQPWFAAIYRRGHHGSFHYRCGGSLISPCWVISATHCFIDKPKKEDYIVYLGRSRLNSNTQGEMKFEVENLILHKDYSADSRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGRGCALKDRPGVYTRVSHFLPWIRSHTKEENGLAL

SEQ ID NO: 337 - protein, 253 aa, synthetic construct
  REGION 1..253: note = UROKINASE-TYPE PLASMINOGEN ACTIVATOR (u-PA) protease domain H37G/R37aD/G37bD/V38F/T39H/V41R/Y60bK/T97aS/L97bR/ H99E/C122S/Y151L/E175D/Q192T/R217E
IIGGEFTTIENQPWFAAIYRRGHHGSFHYRCGGSLISPCWVISATHCFIDKPKKEDYIVYLGRSRLNSNTQGEMKFEVENLILHKDYSADSRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDKPGVYTRVSHFLPWIRSHTKEENGLAL

SEQ ID NO: 338 - protein, 253 aa, synthetic construct
  REGION 1..253: note = UROKINASE-TYPE PLASMINOGEN ACTIVATOR (u-PA) protease domain H37G/R37aD/V38F/T39H/V41R/Y60bK/L97bR/H99E/C122S/Y 151L/E175D/Q192T/R217E/K224R
IIGGEFTTIENQPWFAAIYRRGDGGSFHYRCGGSLISPCWVISATHCFIDKPKKEDYIVYLGRSRLNSNTQGEMKFEVENLILHKDYSADTRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDRPGVYTRVSHFLPWIRSHTKEENGLAL

SEQ ID NO: 339 - protein, 253 aa, synthetic construct
  REGION 1..253: note = UROKINASE-TYPE PLASMINOGEN ACTIVATOR (u-PA) protease domain H37G/R37aD/V38F/T39H/V41R/Y60bK/T97aS/L97bR/H99E/C 122S/Y151L/E175D/Q192T/R217E
IIGGEFTTIENQPWFAAIYRRGDGGSFHYRCGGSLISPCWVISATHCFIDKPKKEDYIVYLGRSRLNSNTQGEMKFEVENLILHKDYSADSRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDKPGVYTRVSHFLPWIRSHTKEENGLAL

SEQ ID NO: 340 - protein, 253 aa, synthetic construct
  REGION 1..253: note = UROKINASE-TYPE PLASMINOGEN ACTIVATOR (u-PA) protease domain H37G/R37aD/G37bD/V38F/T39H/V41R/Y60bK/L97bR/H99E/C 122S/Y151L/E175D/Q192T/R217E
IIGGEFTTIENQPWFAAIYRRGDDGSFHYRCGGSLISPCWVISATHCFIDKPKKEDYIVYLGRSRLNSNTQGEMKFEVENLILHKDYSADTRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDKPGVYTRVSHFLPWIRSHTKEENGLAL

SEQ ID NO: 341 - protein, 253 aa, synthetic construct
  REGION 1..253: note = UROKINASE-TYPE PLASMINOGEN ACTIVATOR (u-PA) protease domain H37G/R37aD/V38F/T39H/V41R/Y60bK/L97bR/H99E/C122S/Y 151L/E175D/Q192T/R217E
IIGGEFTTIENQPWFAAIYRRGDGGSFHYRCGGSLISPCWVISATHCFIDKPKKEDYIVYLGRSRLNSNTQGEMKFEVENLILHKDYSADTRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDKPGVYTRVSHFLPWIRSHTKEENGLAL

SEQ ID NO: 342 - protein, 253 aa, synthetic construct
  REGION 1..253: note = UROKINASE-TYPE PLASMINOGEN ACTIVATOR (u-PA) protease domain V38D/C122S/S190H/G216A
IIGGEFTTIENQPWFAAIYRRHRGGSDTYVCGGSLISPCWVISATHCFIDYPKKEDYIVYLGRSRLNSNTQGEMKFEVENLILHKDYSADTLAHHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDHCQGDSGGPLVCSLQGRMTLTGIVSWARGCALKDKPGVYTRVSHFLPWIRSHTKEENGLAL

SEQ ID NO: 343 - protein, 253 aa, synthetic construct
  REGION 1..253: note = UROKINASE-TYPE PLASMINOGEN ACTIVATOR (u-PA) protease domain V41L/L97bA/H99Q/C122S
IIGGEFTTIENQPWFAAIYRRHRGGSVTYLCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 344 - protein, 253 aa, synthetic construct
  REGION 1..253: note = UROKINASE-TYPE PLASMINOGEN ACTIVATOR (u-PA) protease domain Y40Q/V41L/C122S
IIGGEFTTIENQPWFAAIYRRHRGGSVTQLCGGSLISPCWVISATHCFIDYPKKEDYIVYLGRSRLNSNTQGEMKFEVENLILHKDYSADTLAHHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 345 - protein, 253 aa, synthetic construct
  REGION 1..253: note = UROKINASE-TYPE PLASMINOGEN ACTIVATOR (u-PA) protease domain Y40Q/V41L/H99Q/C122S
IIGGEFTTIENQPWFAAIYRRHRGGSVTQLCGGSLISPCWVISATHCFIDYPKKEDYIVYLGRSRLNSNTQGEMKFEVENLILHKDYSADTLAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 346 - protein, 253 aa, synthetic construct
  REGION 1..253: note = UROKINASE-TYPE PLASMINOGEN ACTIVATOR (u-PA) protease domain Y40Q/V41L/L97bA/H99Q/C122S/Y149R
IIGGEFTTIENQPWFAAIYRRHRGGSVTQLCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 347 - protein, 253 aa, synthetic construct
  REGION 1..253: note = UROKINASE-TYPE PLASMINOGEN ACTIVATOR (u-PA) protease domain R37aE/Y40Q/V41L/L97bA/H99Q/C122S
IIGGEFTTIENQPWFAAIYRRHEGGSVTQLCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 348 - protein, 253 aa, synthetic construct
  REGION 1..253: note = UROKINASE-TYPE PLASMINOGEN ACTIVATOR (u-PA) protease domain R37aE/Y40Q/V41L/L97bA/H99Q/C122S/Y149R
IIGGEFTTIENQPWFAAIYRRHEGGSVTQLCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 349 - protein, 253 aa, synthetic construct
  REGION 1..253: note = UROKINASE-TYPE PLASMINOGEN ACTIVATOR (u-PA) protease domain Y40Q/V41L/Y60bE/L97bA/H99Q/C122S/Y149R
IIGGEFTTIENQPWFAAIYRRHRGGSVTQLCGGSLISPCWVISATHCFIDEPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 350 - protein, 253 aa, synthetic construct
  REGION 1..253: note = UROKINASE-TYPE PLASMINOGEN ACTIVATOR (u-PA) protease domain Y40Q/V41L/Y60bT/T97aE/L97bA/H99Q/C122S/Y149R
IIGGEFTTIENQPWFAAIYRRHRGGSVTQLCGGSLISPCWVISATHCFIDTPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 351 - protein, 253 aa, synthetic construct
  REGION 1..253: note = UROKINASE-TYPE PLASMINOGEN ACTIVATOR (u-PA) protease domain Y40Q/V41L/Y60bS/T97aE/L97bA/H99Q/C122S/Y149R
IIGGEFTTIENQPWFAAIYRRHRGGSVTQLCGGSLISPCWVISATHCFIDSPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 352 - protein, 253 aa, synthetic construct
  REGION 1..253: note = UROKINASE-TYPE PLASMINOGEN ACTIVATOR (u-PA) protease domain R37aE/Y40Q/V41L/L97bA/C122S
IIGGEFTTIENQPWFAAIYRRHEGGSVTQLCGGSLISPCWVISATHCFIDYPKKEDYIVYLGRSRLNSNTQGEMKFEVENLILHKDYSADTAAHHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 353 - protein, 253 aa, synthetic construct
  REGION 1..253: note = UROKINASE-TYPE PLASMINOGEN ACTIVATOR (u-PA) protease domain Y40Q/V41L/L97bA/C122S/Y149R
IIGGEFTTIENQPWFAAIYRRHRGGSVTQLCGGSLISPCWVISATHCFIDYPKKEDYIVYLGRSRLNSNTQGEMKFEVENLILHKDYSADTAAHHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 354 - protein, 253 aa, synthetic construct
  REGION 1..253: note = UROKINASE-TYPE PLASMINOGEN ACTIVATOR (u-PA) protease domain R37aE/Y40Q/V41L/L97bA/C122S/Y149R
IIGGEFTTIENQPWFAAIYRRHEGGSVTQLCGGSLISPCWVISATHCFIDYPKKEDYIVYLGRSRLNSNTQGEMKFEVENLILHKDYSADTAAHHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 355 - protein, 253 aa, synthetic construct
  REGION 1..253: note = UROKINASE-TYPE PLASMINOGEN ACTIVATOR (u-PA) protease domain R37aE/Y40Q/V41L/Y60bE/L97bA/H99Q/C122S/Y149R
IIGGEFTTIENQPWFAAIYRRHEGGSVTQLCGGSLISPCWVISATHCFIDEPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 356 - protein, 253 aa, synthetic construct
  REGION 1..253: note = UROKINASE-TYPE PLASMINOGEN ACTIVATOR (u-PA) protease domain R35K/Y40Q/V41L/Y60bE/L97bA/H99Q/C122S/Y149R
IIGGEFTTIENQPWFAAIYKRHRGGSVTQLCGGSLISPCWVISATHCFIDEPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 357 - protein, 253 aa, synthetic construct
  REGION 1..253: note = UROKINASE-TYPE PLASMINOGEN ACTIVATOR (u-PA) protease domain R37aD/Y40Q/V41L/Y60bT/T97aE/L97bA/H99Q/C122S/Y149R
IIGGEFTTIENQPWFAAIYRRHDGGSVTQLCGGSLISPCWVISATHCFIDTPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 358 - protein, 253 aa, synthetic construct
  REGION 1..253: note = UROKINASE-TYPE PLASMINOGEN ACTIVATOR (u-PA) protease domain R35S/Y40Q/V41L/Y60bT/T97aE/L97bA/H99Q/C122S/Y149R
IIGGEFTTIENQPWFAAIYSRHRGGSVTQLCGGSLISPCWVISATHCFIDTPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 359 - protein, 253 aa, synthetic construct
  REGION 1..253: note = UROKINASE-TYPE PLASMINOGEN ACTIVATOR (u-PA) protease domain R37aE/Y40Q/V41L/Y60bS/T97aE/L97bA/H99Q/C122S/Y149R
IIGGEFTTIENQPWFAAIYRRHEGGSVTQLCGGSLISPCWVISATHCFIDSPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 360 - protein, 253 aa, synthetic construct
  REGION 1..253: note = UROKINASE-TYPE PLASMINOGEN ACTIVATOR (u-PA) protease domain R35V/Y40Q/V41L/Y60bS/T97aE/L97bA/H99Q/C122S/Y149R
IIGGEFTTIENQPWFAAIYVRHRGGSVTQLCGGSLISPCWVISATHCFIDSPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 361 - protein, 253 aa, synthetic construct
  REGION 1..253: note = UROKINASE-TYPE PLASMINOGEN ACTIVATOR (u-PA) protease domain R37aD/Y40Q/V41L/Y60bE/L97bA/H99Q/C122S/Y149R
IIGGEFTTIENQPWFAAIYRRHDGGSVTQLCGGSLISPCWVISATHCFIDEPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 362 - protein, 253 aa, synthetic construct
  REGION 1..253: note = UROKINASE-TYPE PLASMINOGEN ACTIVATOR (u-PA) protease domain R35V/R37aE/V38E/V41L/Y60bS/T97aE/L97bA/H99Q/C122S/ Y149R
IIGGEFTTIENQPWFAAIYVRHEGGSETYLCGGSLISPCWVISATHCFIDSPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 363 - protein, 253 aa, synthetic construct
  REGION 1..253: note = UROKINASE-TYPE PLASMINOGEN ACTIVATOR (u-PA) protease domain R35V/R37aE/Y40Q/Y60bS/T97aE/L97bA/H99Q/C122S/Y149R
IIGGEFTTIENQPWFAAIYVRHEGGSVTQVCGGSLISPCWVISATHCFIDSPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 364 - protein, 253 aa, synthetic construct
  REGION 1..253: note = UROKINASE-TYPE PLASMINOGEN ACTIVATOR (u-PA) protease domain R35V/R37aE/V38E/Y40Q/V41L/T97aE/L97bA/H99Q/C122S/Y 149R
IIGGEFTTIENQPWFAAIYVRHEGGSETQLCGGSLISPCWVISATHCFIDYPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 365 - protein, 253 aa, synthetic construct
  REGION 1..253: note = UROKINASE-TYPE PLASMINOGEN ACTIVATOR (u-PA) protease domain R35V/R37aE/V38E/Y40Q/V41L/Y60bS/L97bA/H99Q/C122S/Y 149R
IIGGEFTTIENQPWFAAIYVRHEGGSETQLCGGSLISPCWVISATHCFIDSPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 366 - protein, 253 aa, synthetic construct
  REGION 1..253: note = UROKINASE-TYPE PLASMINOGEN ACTIVATOR (u-PA) protease domain R35V/R37aE/V38E/Y40Q/V41L/Y60bS/T97aE/H99Q/C122S/Y 149R
IIGGEFTTIENQPWFAAIYVRHEGGSETQLCGGSLISPCWVISATHCFIDSPKKEDYIVYLGRSRLNSNTQGEMKFEVENLILHKDYSADELAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 367 - protein, 253 aa, synthetic construct
  REGION 1..253: note = UROKINASE-TYPE PLASMINOGEN ACTIVATOR (u-PA) protease domain R35V/R37aE/V38E/Y40Q/V41L/Y60bS/T97aE/L97bA/C122S/ Y149R
IIGGEFTTIENQPWFAAIYVRHEGGSETQLCGGSLISPCWVISATHCFIDSPKKEDYIVYLGRSRLNSNTQGEMKFEVENLILHKDYSADEAAHHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 368 - protein, 253 aa, synthetic construct
  REGION 1..253: note = UROKINASE-TYPE PLASMINOGEN ACTIVATOR (u-PA) protease domain R35V/R37aE/V38E/Y40Q/V41L/Y60bS/T97aE/L97bA/H99Q/C 122S
IIGGEFTTIENQPWFAAIYVRHEGGSETQLCGGSLISPCWVISATHCFIDSPKKEDYIVYLGRSRLNSNTQGEMKFEVENLILHKDYSADEAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 369 - protein, 253 aa, synthetic construct
  REGION 1..253: note = UROKINASE-TYPE PLASMINOGEN ACTIVATOR (u-PA) protease domain V41R/L97bR/H99Q/C122S/Y151L/R217V
IIGGEFTTIENQPWFAAIYRRHRGGSVTYRCGGSLISPCWVISATHCFIDYPKKEDYIVYLGRSRLNSNTQGEMKFEVENLILHKDYSADTRAQHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCQGDSGGPLVCSLQGRMTLTGIVSWGVGCALKDKPGVYTRVSHFLPWIRSHTKEENGLAL

SEQ ID NO: 370 - protein, 253 aa, synthetic construct
  REGION 1..253: note = UROKINASE-TYPE PLASMINOGEN ACTIVATOR (u-PA) protease domain V38D/V41R/H99Q/C122S/Y151L/R217V
IIGGEFTTIENQPWFAAIYRRHRGGSDTYRCGGSLISPCWVISATHCFIDYPKKEDYIVYLGRSRLNSNTQGEMKFEVENLILHKDYSADTLAQHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCQGDSGGPLVCSLQGRMTLTGIVSWGVGCALKDKPGVYTRVSHFLPWIRSHTKEENGLAL

SEQ ID NO: 371 - protein, 253 aa, synthetic construct
  REGION 1..253: note = UROKINASE-TYPE PLASMINOGEN ACTIVATOR (u-PA) protease domain V38D/V41R/L97bR/C122S/Y151L/R217V
IIGGEFTTIENQPWFAAIYRRHRGGSDTYRCGGSLISPCWVISATHCFIDYPKKEDYIVYLGRSRLNSNTQGEMKFEVENLILHKDYSADTRAHHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCQGDSGGPLVCSLQGRMTLTGIVSWGVGCALKDKPGVYTRVSHFLPWIRSHTKEENGLAL

SEQ ID NO: 372 - protein, 253 aa, synthetic construct
  REGION 1..253: note = UROKINASE-TYPE PLASMINOGEN ACTIVATOR (u-PA) protease domain R37aE/V38E/Y40Q/V41L/Y60bS/T97aE/L97bA/H99Q/C122S/ Y149R
IIGGEFTTIENQPWFAAIYRRHEGGSETQLCGGSLISPCWVISATHCFIDSPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 373 - protein, 253 aa, synthetic construct
  REGION 1..253: note = UROKINASE-TYPE PLASMINOGEN ACTIVATOR (u-PA) protease domain R35V/V38E/Y40Q/V41L/Y60bS/T97aE/L97bA/H99Q/C122S/Y 149R
IIGGEFTTIENQPWFAAIYVRHRGGSETQLCGGSLISPCWVISATHCFIDSPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 374 - protein, 253 aa, synthetic construct
  REGION 1..253: note = UROKINASE-TYPE PLASMINOGEN ACTIVATOR (u-PA) protease domain R35V/R37aE/Y40Q/V41L/Y60bS/T97aE/L97bA/H99Q/C122S/ Y149R
IIGGEFTTIENQPWFAAIYVRHEGGSVTQLCGGSLISPCWVISATHCFIDSPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 375 - protein, 253 aa, synthetic construct
  REGION 1..253: note = UROKINASE-TYPE PLASMINOGEN ACTIVATOR (u-PA) protease domain R35V/R37aE/V38E/Y40Q/Y60bS/T97aE/L97bA/H99Q/C122S/ Y149R
IIGGEFTTIENQPWFAAIYVRHEGGSETQVCGGSLISPCWVISATHCFIDSPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 376 - protein, 253 aa, synthetic construct
  REGION 1..253: note = UROKINASE-TYPE PLASMINOGEN ACTIVATOR (u-PA) protease domain L97bR/H99Q/C122S/Y151L/R217V
IIGGEFTTIENQPWFAAIYRRHRGGSVTYVCGGSLISPCWVISATHCFIDYPKKEDYIVYLGRSRLNSNTQGEMKFEVENLILHKDYSADTRAQHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCQGDSGGPLVCSLQGRMTLTGIVSWGVGCALKDKPGVYTRVSHFLPWIRSHTKEENGLAL

SEQ ID NO: 377 - protein, 253 aa, synthetic construct
  REGION 1..253: note = UROKINASE-TYPE PLASMINOGEN ACTIVATOR (u-PA) protease domain V38D/H99Q/C122S/Y151L/R217V
IIGGEFTTIENQPWFAAIYRRHRGGSDTYVCGGSLISPCWVISATHCFIDYPKKEDYIVYLGRSRLNSNTQGEMKFEVENLILHKDYSADTLAQHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCQGDSGGPLVCSLQGRMTLTGIVSWGVGCALKDKPGVYTRVSHFLPWIRSHTKEENGLAL

SEQ ID NO: 378 - protein, 253 aa, synthetic construct
  REGION 1..253: note = UROKINASE-TYPE PLASMINOGEN ACTIVATOR (u-PA) protease domain V38D/L97bR/C122S/Y151L/R217V
IIGGEFTTIENQPWFAAIYRRHRGGSDTYVCGGSLISPCWVISATHCFIDYPKKEDYIVYLGRSRLNSNTQGEMKFEVENLILHKDYSADTRAHHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCQGDSGGPLVCSLQGRMTLTGIVSWGVGCALKDKPGVYTRVSHFLPWIRSHTKEENGLAL

SEQ ID NO: 379 - protein, 253 aa, synthetic construct
  REGION 1..253: note = UROKINASE-TYPE PLASMINOGEN ACTIVATOR (u-PA) protease domain V38D/L97bR/H99Q/C122S/R217V
IIGGEFTTIENQPWFAAIYRRHRGGSDTYVCGGSLISPCWVISATHCFIDYPKKEDYIVYLGRSRLNSNTQGEMKFEVENLILHKDYSADTRAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGVGCALKDKPGVYTRVSHFLPWIRSHTKEENGLAL

SEQ ID NO: 380 - protein, 253 aa, synthetic construct; identical to SEQ ID NO: 376
  REGION 1..253: note = UROKINASE-TYPE PLASMINOGEN ACTIVATOR (u-PA) protease domain L97bR/H99Q/C122S/Y151L/R217V

SEQ ID NO: 381 - protein, 253 aa, synthetic construct
  REGION 1..253: note = UROKINASE-TYPE PLASMINOGEN ACTIVATOR (u-PA) protease domain H99Q/C122S/Y151L/R217V
IIGGEFTTIENQPWFAAIYRRHRGGSVTYVCGGSLISPCWVISATHCFIDYPKKEDYIVYLGRSRLNSNTQGEMKFEVENLILHKDYSADTLAQHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCQGDSGGPLVCSLQGRMTLTGIVSWGVGCALKDKPGVYTRVSHFLPWIRSHTKEENGLAL

SEQ ID NO: 382 - protein, 253 aa, synthetic construct
  REGION 1..253: note = UROKINASE-TYPE PLASMINOGEN ACTIVATOR (u-PA) protease domain V41R/H99Q/C122S/Y151L/R217V
IIGGEFTTIENQPWFAAIYRRHRGGSVTYRCGGSLISPCWVISATHCFIDYPKKEDYIVYLGRSRLNSNTQGEMKFEVENLILHKDYSADTLAQHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCQGDSGGPLVCSLQGRMTLTGIVSWGVGCALKDKPGVYTRVSHFLPWIRSHTKEENGLAL

SEQ ID NO: 383 - protein, 253 aa, synthetic construct
  REGION 1..253: note = UROKINASE-TYPE PLASMINOGEN ACTIVATOR (u-PA) protease domain L97bR/H99Q/C122S/Y151L
IIGGEFTTIENQPWFAAIYRRHRGGSVTYVCGGSLISPCWVISATHCFIDYPKKEDYIVYLGRSRLNSNTQGEMKFEVENLILHKDYSADTRAQHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 384 - protein, 253 aa, synthetic construct
  REGION 1..253: note = UROKINASE-TYPE PLASMINOGEN ACTIVATOR (u-PA) protease domain L97bR/C122S/Y151L/R217V
IIGGEFTTIENQPWFAAIYRRHRGGSVTYVCGGSLISPCWVISATHCFIDYPKKEDYIVYLGRSRLNSNTQGEMKFEVENLILHKDYSADTRAHHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCQGDSGGPLVCSLQGRMTLTGIVSWGVGCALKDKPGVYTRVSHFLPWIRSHTKEENGLAL

SEQ ID NO: 385 - protein, 253 aa, synthetic construct
  REGION 1..253: note = UROKINASE-TYPE PLASMINOGEN ACTIVATOR (u-PA) protease domain R37aS/V41R/L97bG/H99Q/C122S/R217V
IIGGEFTTIENQPWFAAIYRRHSGGSVTYRCGGSLISPCWVISATHCFIDYPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGVGCALKDKPGVYTRVSHFLPWIRSHTKEENGLAL

SEQ ID NO: 386 - protein, 253 aa, synthetic construct
  REGION 1..253: note = UROKINASE-TYPE PLASMINOGEN ACTIVATOR (u-PA) protease domain R37aS/V41R/L97bG/C122S/R217V
IIGGEFTTIENQPWFAAIYRRHSGGSVTYRCGGSLISPCWVISATHCFIDYPKKEDYIVYLGRSRLNSNTQGEMKFEVENLILHKDYSADTGAHHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGVGCALKDKPGVYTRVSHFLPWIRSHTKEENGLAL

SEQ ID NO: 387 - protein, 253 aa, synthetic construct
  REGION 1..253: note = UROKINASE-TYPE PLASMINOGEN ACTIVATOR (u-PA) protease domain Y40H/V41Q/L97bG/H99Q/C122S/R217T
IIGGEFTTIENQPWFAAIYRRHRGGSVTHQCGGSLISPCWVISATHCFIDYPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGVGCALKDKPGVYTRVSHFLPWIRSHTKEENGLAL

SEQ ID NO: 388 - protein, 253 aa, synthetic construct
  REGION 1..253: note = UROKINASE-TYPE PLASMINOGEN ACTIVATOR (u-PA) protease domain Y40H/V41Q/L97bG/C122S/R217T
IIGGEFTTIENQPWFAAIYRRHRGGSVTHQCGGSLISPCWVISATHCFIDYPKKEDYIVYLGRSRLNSNTQGEMKFEVENLILHKDYSADTGAHHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGVGCALKDKPGVYTRVSHFLPWIRSHTKEENGLAL

SEQ ID NO: 389 - protein, 253 aa, synthetic construct
  REGION 1..253: note = UROKINASE-TYPE PLASMINOGEN ACTIVATOR (u-PA) protease domain Y40H/V41Q/L97bG/H99Q/C122S
IIGGEFTTIENQPWFAAIYRRHRGGSVTHQCGGSLISPCWVISATHCFIDYPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 390 - protein, 253 aa, synthetic construct
  REGION 1..253: note = UROKINASE-TYPE PLASMINOGEN ACTIVATOR (u-PA) protease domain Y40H/V41T/L97bG/H99Q/C122S/R217T
IIGGEFTTIENQPWFAAIYRRHRGGSVTHTCGGSLISPCWVISATHCFIDYPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGTGCALKDKPGVYTRVSHFLPWIRSHTKEENGLAL

SEQ ID NO: 391 - protein, 253 aa, synthetic construct
  REGION 1..253: note = UROKINASE-TYPE PLASMINOGEN ACTIVATOR (u-PA) protease domain Y40H/V41T/L97bG/C122S/R217T
IIGGEFTTIENQPWFAAIYRRHRGGSVTHTCGGSLISPCWVISATHCFIDYPKKEDYIVYLGRSRLNSNTQGEMKFEVENLILHKDYSADTGAHHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGTGCALKDKPGVYTRVSHFLPWIRSHTKEENGLAL

SEQ ID NO: 392 - protein, 253 aa, synthetic construct
  REGION 1..253: note = UROKINASE-TYPE PLASMINOGEN ACTIVATOR (u-PA) protease domain Y40H/V41T/L97bG/H99Q/C122S
IIGGEFTTIENQPWFAAIYRRHRGGSVTHTCGGSLISPCWVISATHCFIDYPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 393 - protein, 253 aa, synthetic construct
  REGION 1..253: note = UROKINASE-TYPE PLASMINOGEN ACTIVATOR (u-PA) protease domain V41R/L97bG/H99Q/C122S
IIGGEFTTIENQPWFAAIYRRHRGGSVTYRCGGSLISPCWVISATHCFIDYPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 394 - protein, 253 aa, synthetic construct
  REGION 1..253: note = UROKINASE-TYPE PLASMINOGEN ACTIVATOR (u-PA) protease domain V41Q/L97bG/H99Q/C122S
IIGGEFTTIENQPWFAAIYRRHRGGSVTYQCGGSLISPCWVISATHCFIDYPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 395 - protein, 253 aa, synthetic construct
  REGION 1..253: note = UROKINASE-TYPE PLASMINOGEN ACTIVATOR (u-PA) protease domain V41T/L97bG/H99Q/C122S
IIGGEFTTIENQPWFAAIYRRHRGGSVTYTCGGSLISPCWVISATHCFIDYPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 396 - protein, 253 aa, synthetic construct
  REGION 1..253: note = UROKINASE-TYPE PLASMINOGEN ACTIVATOR (u-PA) protease domain T39Y/V41R/L97bA/C122S
IIGGEFTTIENQPWFAAIYRRHRGGSVYYRCGGSLISPCWVISATHCFIDYPKKEDYIVYLGRSRLNSNTQGEMKFEVENLILHKDYSADTAAHHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 397 - protein, 253 aa, synthetic construct
  REGION 1..253: note = UROKINASE-TYPE PLASMINOGEN ACTIVATOR (u-PA) protease domain T39Y/V41R/Y60bQ/L97bA/C122S
IIGGEFTTIENQPWFAAIYRRHRGGSVYYRCGGSLISPCWVISATHCFIDQPKKEDYIVYLGRSRLNSNTQGEMKFEVENLILHKDYSADTAAHHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 398 - protein, 253 aa, synthetic construct
  REGION 1..253: note = UROKINASE-TYPE PLASMINOGEN ACTIVATOR (u-PA) protease domain T39Y/V41R/D60aP/Y60bQ/L97bA/H99Q/C122S
IIGGEFTTIENQPWFAAIYRRHRGGSVYYRCGGSLISPCWVISATHCFIPQPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 399 - protein, 253 aa, synthetic construct
  REGION 1..253: note = UROKINASE-TYPE PLASMINOGEN ACTIVATOR (u-PA) protease domain T39Y/V41R/L97bG/H99Q/C122S
IIGGEFTTIENQPWFAAIYRRHRGGSVYYRCGGSLISPCWVISATHCFIDYPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 400 - protein, 253 aa, synthetic construct
  REGION 1..253: note = UROKINASE-TYPE PLASMINOGEN ACTIVATOR (u-PA) protease domain T39H/V41R/L97bG/H99Q/C122S
IIGGEFTTIENQPWFAAIYRRHRGGSVHYRCGGSLISPCWVISATHCFIDYPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 401 - protein, 253 aa, synthetic construct
  REGION 1..253: note = UROKINASE-TYPE PLASMINOGEN ACTIVATOR (u-PA) protease domain T39W/V41R/L97bG/H99Q/C122S
IIGGEFTTIENQPWFAAIYRRHRGGSVWYRCGGSLISPCWVISATHCFIDYPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 402 - protein, 253 aa, synthetic construct
  REGION 1..253: note = UROKINASE-TYPE PLASMINOGEN ACTIVATOR (u-PA) protease domain T39Y/V41R/Y60bQ/L97bG/H99Q/C122S
IIGGEFTTIENQPWFAAIYRRHRGGSVYYRCGGSLISPCWVISATHCFIDQPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 403 - protein, 253 aa, synthetic construct
  REGION 1..253: note = UROKINASE-TYPE PLASMINOGEN ACTIVATOR (u-PA) protease domain T39Y/V41R/Y60bP/L97bA/H99Q/C122S
IIGGEFTTIENQPWFAAIYRRHRGGSVYYRCGGSLISPCWVISATHCFIDPPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 404 - protein, 253 aa, synthetic construct
  REGION 1..253: note = UROKINASE-TYPE PLASMINOGEN ACTIVATOR (u-PA) protease domain T39Y/V41R/Y60bP/L97bG/H99Q/C122S
IIGGEFTTIENQPWFAAIYRRHRGGSVYYRCGGSLISPCWVISATHCFIDPPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 405 - protein, 251 aa, synthetic construct
  REGION 1..251: note = UROKINASE-TYPE PLASMINOGEN ACTIVATOR (u-PA) protease domain V38D/V41S/A96_T97adelinsERG/A98_H99del/C122S/E175A
IIGGEFTTIENQPWFAAIYRRHRGGSDTYSCGGSLISPCWVISATHCFIDYPKKEDYIVYLGRSRLNSNTQGEMKFEVENLILHKDYSERGLHNDIALLKIRSKEGRCAQPSRTIQTISLPSMYNDPQFGTSCEITGFGKENSTDYLYPEQLKMTVVKLISHRECQQPHYYGSAVTTKMLCAADPQWKTDSCQGDSGGPLVCSLQGRMTLTGIVSWGRGCALKDKPGVYTRVSHFLPWIRSHTKEENGLAL

SEQ ID NO: 406 - protein, 251 aa, synthetic construct
  REGION 1..251: note = UROKINASE-TYPE PLASMINOGEN ACTIVATOR (u-PA) protease domain V38D/V41S/A96D/D97E/T97aG/A98_H99del/C122S/E175S
IIGGEFTTIENQPWFAAIYRRHRGGSDTYSCGGSLISPCWVISATHCFIDYPKKEDYIVYLGRSRLNSNTQGEMKFEVENLILHKDYSDEGLHNDIALLKIRSKEGRCAQPSRTIQTISLPSMYNDPQFGTSCEITGFGKENSTDYLYPEQLKMTVVKLISHRECQQPHYYGSSVTTKMLCAADPQWKTDSCQGDSGGPLVCSLQGRMTLTGIVSWGRGCALKDKPGVYTRVSHFLPWIRSHTKEENGLAL

SEQ ID NO: 407 - protein, 251 aa, synthetic construct
  REGION 1..251: note = UROKINASE-TYPE PLASMINOGEN ACTIVATOR (u-PA) protease domain V38D/V41S/A96E/D97E/T97aG/A98_H99del/C122S/E175K
IIGGEFTTIENQPWFAAIYRRHRGGSDTYSCGGSLISPCWVISATHCFIDYPKKEDYIVYLGRSRLNSNTQGEMKFEVENLILHKDYSEEGLHNDIALLKIRSKEGRCAQPSRTIQTISLPSMYNDPQFGTSCEITGFGKENSTDYLYPEQLKMTVVKLISHRECQQPHYYGSKVTTKMLCAADPQWKTDSCQGDSGGPLVCSLQGRMTLTGIVSWGRGCALKDKPGVYTRVSHFLPWIRSHTKEENGLAL

SEQ ID NO: 408 - protein, 251 aa, synthetic construct
  REGION 1..251: note = UROKINASE-TYPE PLASMINOGEN ACTIVATOR (u-PA) protease domain V38D/V41A/A96_T97adelinsERG/A98_H99del/C122S/E175N
IIGGEFTTIENQPWFAAIYRRHRGGSDTYACGGSLISPCWVISATHCFIDYPKKEDYIVYLGRSRLNSNTQGEMKFEVENLILHKDYSERGLHNDIALLKIRSKEGRCAQPSRTIQTISLPSMYNDPQFGTSCEITGFGKENSTDYLYPEQLKMTVVKLISHRECQQPHYYGSNVTTKMLCAADPQWKTDSCQGDSGGPLVCSLQGRMTLTGIVSWGRGCALKDKPGVYTRVSHFLPWIRSHTKEENGLAL

SEQ ID NO: 409 - protein, 251 aa, synthetic construct
  REGION 1..251: note = UROKINASE-TYPE PLASMINOGEN ACTIVATOR (u-PA) protease domain V38D/V41T/A96E/D97E/T97aG/A98_H99del/C122S/E175K/R 217H
IIGGEFTTIENQPWFAAIYRRHRGGSDTYTCGGSLISPCWVISATHCFIDYPKKEDYIVYLGRSRLNSNTQGEMKFEVENLILHKDYSEEGLHNDIALLKIRSKEGRCAQPSRTIQTISLPSMYNDPQFGTSCEITGFGKENSTDYLYPEQLKMTVVKLISHRECQQPHYYGSKVTTKMLCAADPQWKTDSCQGDSGGPLVCSLQGRMTLTGIVSWGHGCALKDKPGVYTRVSHFLPWIRSHTKEENGLAL

SEQ ID NO: 410 - protein, 251 aa, synthetic construct
  REGION 1..251: note = UROKINASE-TYPE PLASMINOGEN ACTIVATOR (u-PA) protease domain R35K/V38D/T39S/Y40F/V41M/D60aN/A96D/D97L/A98K/T97a del/H99L/L97bdel/C122S/Y151L
IIGGEFTTIENQPWFAAIYKRHRGGSDSFMCGGSLISPCWVISATHCFINYPKKEDYIVYLGRSRLNSNTQGEMKFEVENLILHKDYSDLKLHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 411 - protein, 252 aa, synthetic construct
  REGION 1..252: note = UROKINASE-TYPE PLASMINOGEN ACTIVATOR (u-PA) protease domain V38D/V41R/A96E/D97G/T97adelinsSG/A98_H99del/C122S
IIGGEFTTIENQPWFAAIYRRHRGGSDTYRCGGSLISPCWVISATHCFIDYPKKEDYIVYLGRSRLNSNTQGEMKFEVENLILHKDYSEGSGLHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 412 - protein, 253 aa, synthetic construct
  REGION 1..253: note = UROKINASE-TYPE PLASMINOGEN ACTIVATOR (u-PA) protease domain V38D/L97bG/H99P/C122S/R217V/K224Q
IIGGEFTTIENQPWFAAIYRRHRGGSDTYVCGGSLISPCWVISATHCFIDYPKKEDYIVYLGRSRLNSNTQGEMKFEVENLILHKDYSADTGAPHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGVGCALKDQPGVYTRVSHFLPWIRSHTKEENGLAL

SEQ ID NO: 413 - protein, 251 aa, synthetic construct
  REGION 1..251: note = UROKINASE-TYPE PLASMINOGEN ACTIVATOR (u-PA) protease domain V38D/A96G/D97R/A98G/T97adel/H99I/L97bdel/C122S
IIGGEFTTIENQPWFAAIYRRHRGGSDTYVCGGSLISPCWVISATHCFIDYPKKEDYIVYLGRSRLNSNTQGEMKFEVENLILHKDYSGRGIHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 414 - protein, 251 aa, synthetic construct
  REGION 1..251: note = UROKINASE-TYPE PLASMINOGEN ACTIVATOR (u-PA) protease domain V38D/A96E/D97E/T97aG/A98_H99del/L97bM/C122S
IIGGEFTTIENQPWFAAIYRRHRGGSDTYVCGGSLISPCWVISATHCFIDYPKKEDYIVYLGRSRLNSNTQGEMKFEVENLILHKDYSEEGMHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 415 - protein, 252 aa, synthetic construct
  REGION 1..252: note = UROKINASE-TYPE PLASMINOGEN ACTIVATOR (u-PA) protease domain V38D/V41R/A96D/D97G/T97aN/A98G/L97bdel/H99L/C122S/ R217F
IIGGEFTTIENQPWFAAIYRRHRGGSDTYRCGGSLISPCWVISATHCFIDYPKKEDYIVYLGRSRLNSNTQGEMKFEVENLILHKDYSDGNGLHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGFGCALKDKPGVYTRVSHFLPWIRSHTKEENGLAL

SEQ ID NO: 416 - protein, 251 aa, synthetic construct
  REGION 1..251: note = UROKINASE-TYPE PLASMINOGEN ACTIVATOR (u-PA) protease domain V38D/V41Q/A96E/D97E/T97aG/A98_H99del/C122S/R217H
IIGGEFTTIENQPWFAAIYRRHRGGSDTYQCGGSLISPCWVISATHCFIDYPKKEDYIVYLGRSRLNSNTQGEMKFEVENLILHKDYSEEGLHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGHGCALKDKPGVYTRVSHFLPWIRSHTKEENGLAL

SEQ ID NO: 417 - protein, 251 aa, synthetic construct
  REGION 1..251: note = UROKINASE-TYPE PLASMINOGEN ACTIVATOR (u-PA) protease domain V38D/V41R/A96D/D97G/A98G/T97adel/H99L/L97bdel/C122 S/R217D
IIGGEFTTIENQPWFAAIYRRHRGGSDTYRCGGSLISPCWVISATHCFIDYPKKEDYIVYLGRSRLNSNTQGEMKFEVENLILHKDYSDGGLHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGDGCALKDKPGVYTRVSHFLPWIRSHTKEENGLAL

SEQ ID NO: 418 - protein, 251 aa, synthetic construct
  REGION 1..251: note = UROKINASE-TYPE PLASMINOGEN ACTIVATOR (u-PA) protease domain V38D/V41K/A96D/D97E/T97aG/A98_H99del/C122S/R217K/K 224N
IIGGEFTTIENQPWFAAIYRRHRGGSDTYKCGGSLISPCWVISATHCFIDYPKKEDYIVYLGRSRLNSNTQGEMKFEVENLILHKDYSDEGLHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGKGCALKDNPGVYTRVSHFLPWIRSHTKEENGLAL

SEQ ID NO: 419 - protein, 251 aa, synthetic construct
  REGION 1..251: note = UROKINASE-TYPE PLASMINOGEN ACTIVATOR (u-PA) protease domain R36H/V38D/V41M/D97E/A98G/T97adel/H99L/L97bdel/C122 S/R217D
IIGGEFTTIENQPWFAAIYRHHRGGSDTYMCGGSLISPCWVISATHCFIDYPKKEDYIVYLGRSRLNSNTQGEMKFEVENLILHKDYSAEGLHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGDGCALKDKPGVYTRVSHFLPWIRSHTKEENGLAL

SEQ ID NO: 420 - protein, 251 aa, synthetic construct
  REGION 1..251: note = UROKINASE-TYPE PLASMINOGEN ACTIVATOR (u-PA) protease domain V38D/V41H/A96D/D97E/T97aG/A98_H99del/C122S/R217del insF
IIGGEFTTIENQPWFAAIYRRHRGGSDTYHCGGSLISPCWVISATHCFIDYPKKEDYIVYLGRSRLNSNTQGEMKFEVENLILHKDYSDEGLHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGFGCALKDKPGVYTRVSHFLPWIRSHTKEENGLAL

SEQ ID NO: 421 - protein, 251 aa, synthetic construct
  REGION 1..251: note = UROKINASE-TYPE PLASMINOGEN ACTIVATOR (u-PA) protease domain V38D/D97E/T97aG/A98_H99del/C122S/E175G/R217H
IIGGEFTTIENQPWFAAIYRRHRGGSDTYVCGGSLISPCWVISATHCFIDYPKKEDYIVYLGRSRLNSNTQGEMKFEVENLILHKDYSAEGLHNDIALLKIRSKEGRCAQPSRTIQTISLPSMYNDPQFGTSCEITGFGKENSTDYLYPEQLKMTVVKLISHRECQQPHYYGSGVTTKMLCAADPQWKTDSCQGDSGGPLVCSLQGRMTLTGIVSWGHGCALKDKPGVYTRVSHFLPWIRSHTKEENGLAL

SEQ ID NO: 422 - protein, 253 aa, synthetic construct
  REGION 1..253: note = UROKINASE-TYPE PLASMINOGEN ACTIVATOR (u-PA) protease domain A32S/V38D/H99E/C122S/K224A
IIGGEFTTIENQPWFASIYRRHRGGSDTYVCGGSLISPCWVISATHCFIDYPKKEDYIVYLGRSRLNSNTQGEMKFEVENLILHKDYSADTLAEHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDAPGVYTRVSHFLPWIRSHTKEENGLAL

SEQ ID NO: 423 - protein, 253 aa, synthetic construct
  REGION 1..253: note = UROKINASE-TYPE PLASMINOGEN ACTIVATOR (u-PA) protease domain V38D/L97bA/H99Q/C122S
IIGGEFTTIENQPWFAAIYRRHRGGSDTYVCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 424 - protein, 253 aa, synthetic construct
  REGION 1..253: note = UROKINASE-TYPE PLASMINOGEN ACTIVATOR (u-PA) protease domain R36S/V38D/L97bR/H99E/C122S/R217D/K224R
IIGGEFTTIENQPWFAAIYRSHRGGSDTYVCGGSLISPCWVISATHCFIDYPKKEDYIVYLGRSRLNSNTQGEMKFEVENLILHKDYSADTRAEHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGDGCALKDRPGVYTRVSHFLPWIRSHTKEENGLAL

SEQ ID NO: 425 - protein, 252 aa, synthetic construct
  REGION 1..252: note = UROKINASE-TYPE PLASMINOGEN ACTIVATOR (u-PA) protease domain V38D/V41Q/A96N/D97G/T97aI/A98G/L97bdel/H99L/C122S
IIGGEFTTIENQPWFAAIYRRHRGGSDTYQCGGSLISPCWVISATHCFIDYPKKEDYIVYLGRSRLNSNTQGEMKFEVENLILHKDYSNGIGLHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 426 - protein, 251 aa, synthetic construct
  REGION 1..251: note = UROKINASE-TYPE PLASMINOGEN ACTIVATOR (u-PA) protease domain R35S/V38D/V41T/A96D/D97G/A98G/T97adel/H99L/L97bdel /C122S
IIGGEFTTIENQPWFAAIYSRHRGGSDTYTCGGSLISPCWVISATHCFIDYPKKEDYIVYLGRSRLNSNTQGEMKFEVENLILHKDYSDGGLHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 427 - protein, 251 aa, synthetic construct
  REGION 1..251: note = UROKINASE-TYPE PLASMINOGEN ACTIVATOR (u-PA) protease domain V38D/V41K/A96K/D97E/A98G/T97adel/H99L/L97bdel/C122 S
IIGGEFTTIENQPWFAAIYRRHRGGSDTYKCGGSLISPCWVISATHCFIDYPKKEDYIVYLGRSRLNSNTQGEMKFEVENLILHKDYSKEGLHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 428 - protein, 251 aa, synthetic construct
  REGION 1..251: note = UROKINASE-TYPE PLASMINOGEN ACTIVATOR (u-PA) protease domain R36H/V38D/V41S/A96E/D97R/A98G/T97adel/H99L/L97bdel /C122S/K224R
IIGGEFTTIENQPWFAAIYRHHRGGSDTYSCGGSLISPCWVISATHCFIDYPKKEDYIVYLGRSRLNSNTQGEMKFEVENLILHKDYSERGLHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDRPGVYTRVSHFLPWIRSHTKEENGLAL

SEQ ID NO: 429 - protein, 251 aa, synthetic construct
  REGION 1..251: note = UROKINASE-TYPE PLASMINOGEN ACTIVATOR (u-PA) protease domain V38D/V41R/A96D/D97G/A98G/T97adel/H99L/L97bdel/C122 S/Y151L/Q192D/R217D
IIGGEFTTIENQPWFAAIYRRHRGGSDTYRCGGSLISPCWVISATHCFIDYPKKEDYIVYLGRSRLNSNTQGEMKFEVENLILHKDYSDGGLHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCDGDSGGPLVCSLQGRMTLTGIVSWGDGCALKDKPGVYTRVSHFLPWIRSHTKEENGLAL

SEQ ID NO: 430 - protein, 251 aa, synthetic construct
  REGION 1..251: note = UROKINASE-TYPE PLASMINOGEN ACTIVATOR (u-PA) protease domain V38D/V41R/A96D/D97G/A98G/T97adel/H99L/L97bdel/C122 S/Y151M/Q192E/R217D
IIGGEFTTIENQPWFAAIYRRHRGGSDTYRCGGSLISPCWVISATHCFIDYPKKEDYIVYLGRSRLNSNTQGEMKFEVENLILHKDYSDGGLHNDIALLKIRSKEGRCAQPSRTIQTISLPSMYNDPQFGTSCEITGFGKENSTDYLMPEQLKMTVVKLISHRECQQPHYYGSEVTTKMLCAADPQWKTDSCEGDSGGPLVCSLQGRMTLTGIVSWGDGCALKDKPGVYTRVSHFLPWIRSHTKEENGLAL

SEQ ID NO: 431 - protein, 251 aa, synthetic construct
  REGION 1..251: note = UROKINASE-TYPE PLASMINOGEN ACTIVATOR (u-PA) protease domain V38D/V41R/A96D/D97G/A98G/T97adel/H99L/L97bdel/C122 S/Y151K/Q192E/R217D
IIGGEFTTIENQPWFAAIYRRHRGGSDTYRCGGSLISPCWVISATHCFIDYPKKEDYIVYLGRSRLNSNTQGEMKFEVENLILHKDYSDGGLHNDIALLKIRSKEGRCAQPSRTIQTISLPSMYNDPQFGTSCEITGFGKENSTDYLKPEQLKMTVVKLISHRECQQPHYYGSEVTTKMLCAADPQWKTDSCEGDSGGPLVCSLQGRMTLTGIVSWGDGCALKDKPGVYTRVSHFLPWIRSHTKEENGLAL

SEQ ID NO: 432 - protein, 251 aa, synthetic construct
  REGION 1..251: note = UROKINASE-TYPE PLASMINOGEN ACTIVATOR (u-PA) protease domain R36H/V38D/V41R/A96D/D97G/T97adel/A98G/L97bdel/H99L /C122S/Y151F/Q192D/R217D
IIGGEFTTIENQPWFAAIYRHHRGGSDTYRCGGSLISPCWVISATHCFIDYPKKEDYIVYLGRSRLNSNTQGEMKFEVENLILHKDYSDGGLHNDIALLKIRSKEGRCAQPSRTIQTISLPSMYNDPQFGTSCEITGFGKENSTDYLFPEQLKMTVVKLISHRECQQPHYYGSEVTTKMLCAADPQWKTDSCDGDSGGPLVCSLQGRMTLTGIVSWGDGCALKDKPGVYTRVSHFLPWIRSHTKEENGLAL

SEQ ID NO: 433 - protein, 251 aa, synthetic construct
  REGION 1..251: note = UROKINASE-TYPE PLASMINOGEN ACTIVATOR (u-PA) protease domain V38D/V41R/A96D/D97G/A98G/T97adel/H99L/L97bdel/C122 S/Y151W/Q192M/R217D
IIGGEFTTIENQPWFAAIYRRHRGGSDTYRCGGSLISPCWVISATHCFIDYPKKEDYIVYLGRSRLNSNTQGEMKFEVENLILHKDYSDGGLHNDIALLKIRSKEGRCAQPSRTIQTISLPSMYNDPQFGTSCEITGFGKENSTDYLWPEQLKMTVVKLISHRECQQPHYYGSEVTTKMLCAADPQWKTDSCMGDSGGPLVCSLQGRMTLTGIVSWGDGCALKDKPGVYTRVSHFLPWIRSHTKEENGLAL

SEQ ID NO: 434 - protein, 251 aa, synthetic construct
  REGION 1..251: note = UROKINASE-TYPE PLASMINOGEN ACTIVATOR (u-PA) protease domain R37aH/V38D/V41R/A96D/D97G/A98G/T97adel/H99L/L97bde l/C122S/Y151L/Q192G/R217D
IIGGEFTTIENQPWFAAIYRRHHGGSDTYRCGGSLISPCWVISATHCFIDYPKKEDYIVYLGRSRLNSNTQGEMKFEVENLILHKDYSDGGLHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCGGDSGGPLVCSLQGRMTLTGIVSWGDGCALKDKPGVYTRVSHFLPWIRSHTKEENGLAL

SEQ ID NO: 435 - protein, 251 aa, synthetic construct
  REGION 1..251: note = UROKINASE-TYPE PLASMINOGEN ACTIVATOR (u-PA) protease domain V38D/Y40P/V41R/A96D/D97G/A98G/T97adel/H99L/L97bdel /C122S/Q192L/R217D
IIGGEFTTIENQPWFAAIYRRHRGGSDTPRCGGSLISPCWVISATHCFIDYPKKEDYIVYLGRSRLNSNTQGEMKFEVENLILHKDYSDGGLHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCLGDSGGPLVCSLQGRMTLTGIVSWGDGCALKDKPGVYTRVSHFLPWIRSHTKEENGLAL

SEQ ID NO: 436 - protein, 251 aa, synthetic construct
  REGION 1..251: note = UROKINASE-TYPE PLASMINOGEN ACTIVATOR (u-PA) protease domain V38D/V41R/A96D/D97G/A98G/T97adel/H99L/L97bdel/C122 S/Y151L/Q192E/R217D
IIGGEFTTIENQPWFAAIYRRHRGGSDTYRCGGSLISPCWVISATHCFIDYPKKEDYIVYLGRSRLNSNTQGEMKFEVENLILHKDYSDGGLHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCEGDSGGPLVCSLQGRMTLTGIVSWGDGCALKDKPGVYTRVSHFLPWIRSHTKEENGLAL

SEQ ID NO: 437 - protein, 251 aa, synthetic construct
  REGION 1..251: note = UROKINASE-TYPE PLASMINOGEN ACTIVATOR (u-PA) protease domain V38D/V41R/A96D/D97G/A98G/T97adel/H99L/L97bdel/C122 S/Y151N/Q192M/R217D
IIGGEFTTIENQPWFAAIYRRHRGGSDTYRCGGSLISPCWVISATHCFIDYPKKEDYIVYLGRSRLNSNTQGEMKFEVENLILHKDYSDGGLHNDIALLKIRSKEGRCAQPSRTIQTISLPSMYNDPQFGTSCEITGFGKENSTDYLNPEQLKMTVVKLISHRECQQPHYYGSEVTTKMLCAADPQWKTDSCMGDSGGPLVCSLQGRMTLTGIVSWGDGCALKDKPGVYTRVSHFLPWIRSHTKEENGLAL

SEQ ID NO: 438 - protein, 251 aa, synthetic construct
  REGION 1..251: note = UROKINASE-TYPE PLASMINOGEN ACTIVATOR (u-PA) protease domain R36H/V38D/Y40F/V41R/D97E/A98G/T97adel/H99L/L97bdel /C122S/Y151L/Q192D/R217D
IIGGEFTTIENQPWFAAIYRHHRGGSDTFRCGGSLISPCWVISATHCFIDYPKKEDYIVYLGRSRLNSNTQGEMKFEVENLILHKDYSAEGLHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCDGDSGGPLVCSLQGRMTLTGIVSWGDGCALKDKPGVYTRVSHFLPWIRSHTKEENGLAL

SEQ ID NO: 439 - protein, 251 aa, synthetic construct
  REGION 1..251: note = UROKINASE-TYPE PLASMINOGEN ACTIVATOR (u-PA) protease domain R36H/V38D/Y40H/V41K/D97E/A98G/T97adel/H99L/L97bdel /C122S/Y151K/Q192V/R217D
IIGGEFTTIENQPWFAAIYRHHRGGSDTHKCGGSLISPCWVISATHCFIDYPKKEDYIVYLGRSRLNSNTQGEMKFEVENLILHKDYSAEGLHNDIALLKIRSKEGRCAQPSRTIQTISLPSMYNDPQFGTSCEITGFGKENSTDYLKPEQLKMTVVKLISHRECQQPHYYGSEVTTKMLCAADPQWKTDSCVGDSGGPLVCSLQGRMTLTGIVSWGDGCALKDKPGVYTRVSHFLPWIRSHTKEENGLAL

SEQ ID NO: 440 - protein, 251 aa, synthetic construct
  REGION 1..251: note = UROKINASE-TYPE PLASMINOGEN ACTIVATOR (u-PA) protease domain R36H/V38D/Y40L/V41K/D97E/A98G/T97adel/H99L/L97bdel /C122S/Y151R/Q192L/R217D
IIGGEFTTIENQPWFAAIYRHHRGGSDTLKCGGSLISPCWVISATHCFIDYPKKEDYIVYLGRSRLNSNTQGEMKFEVENLILHKDYSAEGLHNDIALLKIRSKEGRCAQPSRTIQTISLPSMYNDPQFGTSCEITGFGKENSTDYLRPEQLKMTVVKLISHRECQQPHYYGSEVTTKMLCAADPQWKTDSCLGDSGGPLVCSLQGRMTLTGIVSWGDGCALKDKPGVYTRVSHFLPWIRSHTKEENGLAL

SEQ ID NO: 441 - protein, 251 aa, synthetic construct
  REGION 1..251: note = UROKINASE-TYPE PLASMINOGEN ACTIVATOR (u-PA) protease domain R36H/V38D/Y40V/V41K/D97E/A98G/T97adel/H99L/L97bdel /C122S/Y151F/Q192F/R217D
IIGGEFTTIENQPWFAAIYRHHRGGSDTVKCGGSLISPCWVISATHCFIDYPKKEDYIVYLGRSRLNSNTQGEMKFEVENLILHKDYSAEGLHNDIALLKIRSKEGRCAQPSRTIQTISLPSMYNDPQFGTSCEITGFGKENSTDYLFPEQLKMTVVKLISHRECQQPHYYGSEVTTKMLCAADPQWKTDSCFGDSGGPLVCSLQGRMTLTGIVSWGDGCALKDKPGVYTRVSHFLPWIRSHTKEENGLAL

SEQ ID NO: 442 - protein, 251 aa, synthetic construct
  REGION 1..251: note = UROKINASE-TYPE PLASMINOGEN ACTIVATOR (u-PA) protease domain R36H/V38D/D97E/A98G/T97adel/H99L/L97bdel/C122S/Y15 1K/Q192E/R217D
IIGGEFTTIENQPWFAAIYRHHRGGSDTYVCGGSLISPCWVISATHCFIDYPKKEDYIVYLGRSRLNSNTQGEMKFEVENLILHKDYSAEGLHNDIALLKIRSKEGRCAQPSRTIQTISLPSMYNDPQFGTSCEITGFGKENSTDYLKPEQLKMTVVKLISHRECQQPHYYGSEVTTKMLCAADPQWKTDSCEGDSGGPLVCSLQGRMTLTGIVSWGDGCALKDKPGVYTRVSHFLPWIRSHTKEENGLAL

SEQ ID NO: 443 - protein, 251 aa, synthetic construct
  REGION 1..251: note = UROKINASE-TYPE PLASMINOGEN ACTIVATOR (u-PA) protease domain R36H/V38D/Y40L/V41K/D97E/A98G/T97adel/H99L/L97bdel /C122S/Y151K/Q192E/R217D
IIGGEFTTIENQPWFAAIYRHHRGGSDTLKCGGSLISPCWVISATHCFIDYPKKEDYIVYLGRSRLNSNTQGEMKFEVENLILHKDYSAEGLHNDIALLKIRSKEGRCAQPSRTIQTISLPSMYNDPQFGTSCEITGFGKENSTDYLKPEQLKMTVVKLISHRECQQPHYYGSEVTTKMLCAADPQWKTDSCEGDSGGPLVCSLQGRMTLTGIVSWGDGCALKDKPGVYTRVSHFLPWIRSHTKEENGLAL

SEQ ID NO: 444 - protein, 251 aa, synthetic construct
  REGION 1..251: note = UROKINASE-TYPE PLASMINOGEN ACTIVATOR (u-PA) protease domain R36H/V38D/Y40F/V41R/D97E/A98G/T97adel/H99L/L97bdel /C122S/Y151M/Q192D/R217D
IIGGEFTTIENQPWFAAIYRHHRGGSDTFRCGGSLISPCWVISATHCFIDYPKKEDYIVYLGRSRLNSNTQGEMKFEVENLILHKDYSAEGLHNDIALLKIRSKEGRCAQPSRTIQTISLPSMYNDPQFGTSCEITGFGKENSTDYLMPEQLKMTVVKLISHRECQQPHYYGSEVTTKMLCAADPQWKTDSCDGDSGGPLVCSLQGRMTLTGIVSWGDGCALKDKPGVYTRVSHFLPWIRSHTKEENGLAL

SEQ ID NO: 445 - protein, 251 aa, synthetic construct
  REGION 1..251: note = UROKINASE-TYPE PLASMINOGEN ACTIVATOR (u-PA) protease domain R36H/V38D/Y40L/V41K/D97E/A98G/T97adel/H99L/L97bdel /C122S/Y151L/Q192T/R217D
IIGGEFTTIENQPWFAAIYRHHRGGSDTLKCGGSLISPCWVISATHCFIDYPKKEDYIVYLGRSRLNSNTQGEMKFEVENLILHKDYSAEGLHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCTGDSGGPLVCSLQGRMTLTGIVSWGDGCALKDKPGVYTRVSHFLPWIRSHTKEENGLAL

SEQ ID NO: 446 - protein, 251 aa, synthetic construct
  REGION 1..251: note = UROKINASE-TYPE PLASMINOGEN ACTIVATOR (u-PA) protease domain R36H/V38D/Y40F/V41R/D97E/A98G/T97adel/H99L/L97bdel /C122S/Y151L/Q192E/R217D
IIGGEFTTIENQPWFAAIYRHHRGGSDTFRCGGSLISPCWVISATHCFIDYPKKEDYIVYLGRSRLNSNTQGEMKFEVENLILHKDYSAEGLHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCEGDSGGPLVCSLQGRMTLTGIVSWGDGCALKDKPGVYTRVSHFLPWIRSHTKEENGLAL

SEQ ID NO: 447 - protein, 251 aa, synthetic construct
  REGION 1..251: note = UROKINASE-TYPE PLASMINOGEN ACTIVATOR (u-PA) protease domain R36H/V38D/V41R/D97E/A98G/T97adel/H99L/L97bdel/C122 S/Y151L/Q192G/R217D
IIGGEFTTIENQPWFAAIYRHHRGGSDTYRCGGSLISPCWVISATHCFIDYPKKEDYIVYLGRSRLNSNTQGEMKFEVENLILHKDYSAEGLHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCGGDSGGPLVCSLQGRMTLTGIVSWGDGCALKDKPGVYTRVSHFLPWIRSHTKEENGLAL

SEQ ID NO: 448 - protein, 251 aa, synthetic construct
  REGION 1..251: note = UROKINASE-TYPE PLASMINOGEN ACTIVATOR (u-PA) protease domain R36H/V38D/Y40I/V41K/D97E/A98G/T97adel/H99L/L97bdel /C122S/Q192A/R217D
IIGGEFTTIENQPWFAAIYRHHRGGSDTIKCGGSLISPCWVISATHCFIDYPKKEDYIVYLGRSRLNSNTQGEMKFEVENLILHKDYSAEGLHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCAGDSGGPLVCSLQGRMTLTGIVSWGDGCALKDKPGVYTRVSHFLPWIRSHTKEENGLAL

SEQ ID NO: 449 - protein, 251 aa, synthetic construct
  REGION 1..251: note = UROKINASE-TYPE PLASMINOGEN ACTIVATOR (u-PA) protease domain R36H/V38D/V41K/D97E/A98G/T97adel/H99L/L97bdel/C122 S/Y151K/Q192E/R217D
IIGGEFTTIENQPWFAAIYRHHRGGSDTYKCGGSLISPCWVISATHCFIDYPKKEDYIVYLGRSRLNSNTQGEMKFEVENLILHKDYSAEGLHNDIALLKIRSKEGRCAQPSRTIQTISLPSMYNDPQFGTSCEITGFGKENSTDYLKPEQLKMTVVKLISHRECQQPHYYGSEVTTKMLCAADPQWKTDSCEGDSGGPLVCSLQGRMTLTGIVSWGDGCALKDKPGVYTRVSHFLPWIRSHTKEENGLAL

SEQ ID NO: 450 - protein, 251 aa, synthetic construct
  REGION 1..251: note = UROKINASE-TYPE PLASMINOGEN ACTIVATOR (u-PA) protease domain R36H/V38D/Y40L/V41R/D97E/A98G/T97adel/H99L/L97bdel /C122S/Y151L/Q192D/R217D
IIGGEFTTIENQPWFAAIYRHHRGGSDTLRCGGSLISPCWVISATHCFIDYPKKEDYIVYLGRSRLNSNTQGEMKFEVENLILHKDYSAEGLHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCDGDSGGPLVCSLQGRMTLTGIVSWGDGCALKDKPGVYTRVSHFLPWIRSHTKEENGLAL

SEQ ID NO: 451 - protein, 251 aa, synthetic construct
  REGION 1..251: note = UROKINASE-TYPE PLASMINOGEN ACTIVATOR (u-PA) protease domain R36H/V38D/Y40L/V41R/D97E/A98G/T97adel/H99L/L97bdel /C122S/Y151M/Q192T/R217D
IIGGEFTTIENQPWFAAIYRHHRGGSDTLRCGGSLISPCWVISATHCFIDYPKKEDYIVYLGRSRLNSNTQGEMKFEVENLILHKDYSAEGLHNDIALLKIRSKEGRCAQPSRTIQTISLPSMYNDPQFGTSCEITGFGKENSTDYLMPEQLKMTVVKLISHRECQQPHYYGSEVTTKMLCAADPQWKTDSCTGDSGGPLVCSLQGRMTLTGIVSWGDGCALKDKPGVYTRVSHFLPWIRSHTKEENGLAL

SEQ ID NO: 452 - protein, 251 aa, synthetic construct
  REGION 1..251: note = UROKINASE-TYPE PLASMINOGEN ACTIVATOR (u-PA) protease domain R36H/V38D/Y40L/V41R/D97E/A98G/T97adel/H99L/L97bdel /C122S/Y151L/Q192R/R217D
IIGGEFTTIENQPWFAAIYRHHRGGSDTLRCGGSLISPCWVISATHCFIDYPKKEDYIVYLGRSRLNSNTQGEMKFEVENLILHKDYSAEGLHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCRGDSGGPLVCSLQGRMTLTGIVSWGDGCALKDKPGVYTRVSHFLPWIRSHTKEENGLAL

SEQ ID NO: 453 - protein, 251 aa, synthetic construct
  REGION 1..251: note = UROKINASE-TYPE PLASMINOGEN ACTIVATOR (u-PA) protease domain R36H/V38D/Y40F/V41K/D97E/A98G/T97adel/H99L/L97bdel /C122S/Y151R/Q192E/R217D
IIGGEFTTIENQPWFAAIYRHHRGGSDTFKCGGSLISPCWVISATHCFIDYPKKEDYIVYLGRSRLNSNTQGEMKFEVENLILHKDYSAEGLHNDIALLKIRSKEGRCAQPSRTIQTISLPSMYNDPQFGTSCEITGFGKENSTDYLRPEQLKMTVVKLISHRECQQPHYYGSEVTTKMLCAADPQWKTDSCEGDSGGPLVCSLQGRMTLTGIVSWGDGCALKDKPGVYTRVSHFLPWIRSHTKEENGLAL

SEQ ID NO: 454 - protein, 251 aa, synthetic construct
  REGION 1..251: note = UROKINASE-TYPE PLASMINOGEN ACTIVATOR (u-PA) protease domain R36H/V38D/Y40L/V41R/D97E/A98G/T97adel/H99L/L97bdel /C122S/Y151N/Q192V/R217D
IIGGEFTTIENQPWFAAIYRHHRGGSDTLRCGGSLISPCWVISATHCFIDYPKKEDYIVYLGRSRLNSNTQGEMKFEVENLILHKDYSAEGLHNDIALLKIRSKEGRCAQPSRTIQTISLPSMYNDPQFGTSCEITGFGKENSTDYLNPEQLKMTVVKLISHRECQQPHYYGSEVTTKMLCAADPQWKTDSCVGDSGGPLVCSLQGRMTLTGIVSWGDGCALKDKPGVYTRVSHFLPWIRSHTKEENGLAL

SEQ ID NO: 455 - protein, 251 aa, synthetic construct
  REGION 1..251: note = UROKINASE-TYPE PLASMINOGEN ACTIVATOR (u-PA) protease domain R36H/V38D/Y40L/V41R/D97E/A98G/T97adel/H99L/L97bdel /C122S/Y151N/Q192D/R217D
IIGGEFTTIENQPWFAAIYRHHRGGSDTLRCGGSLISPCWVISATHCFIDYPKKEDYIVYLGRSRLNSNTQGEMKFEVENLILHKDYSAEGLHNDIALLKIRSKEGRCAQPSRTIQTISLPSMYNDPQFGTSCEITGFGKENSTDYLNPEQLKMTVVKLISHRECQQPHYYGSEVTTKMLCAADPQWKTDSCDGDSGGPLVCSLQGRMTLTGIVSWGDGCALKDKPGVYTRVSHFLPWIRSHTKEENGLAL

SEQ ID NO: 456 - protein, 251 aa, synthetic construct
  REGION 1..251: note = UROKINASE-TYPE PLASMINOGEN ACTIVATOR (u-PA) protease domain R36H/V38D/V41R/D97E/A98G/T97adel/H99L/L97bdel/C122 S/Y151K/Q192E/R217D
IIGGEFTTIENQPWFAAIYRHHRGGSDTYRCGGSLISPCWVISATHCFIDYPKKEDYIVYLGRSRLNSNTQGEMKFEVENLILHKDYSAEGLHNDIALLKIRSKEGRCAQPSRTIQTISLPSMYNDPQFGTSCEITGFGKENSTDYLKPEQLKMTVVKLISHRECQQPHYYGSEVTTKMLCAADPQWKTDSCEGDSGGPLVCSLQGRMTLTGIVSWGDGCALKDKPGVYTRVSHFLPWIRSHTKEENGLAL

SEQ ID NO: 457 - protein, 251 aa, synthetic construct
  REGION 1..251: note = UROKINASE-TYPE PLASMINOGEN ACTIVATOR (u-PA) protease domain R36H/V38D/Y40F/V41R/D97E/A98G/T97adel/H99L/L97bdel /C122S/Y151K/Q192E/R217D
IIGGEFTTIENQPWFAAIYRHHRGGSDTFRCGGSLISPCWVISATHCFIDYPKKEDYIVYLGRSRLNSNTQGEMKFEVENLILHKDYSAEGLHNDIALLKIRSKEGRCAQPSRTIQTISLPSMYNDPQFGTSCEITGFGKENSTDYLKPEQLKMTVVKLISHRECQQPHYYGSEVTTKMLCAADPQWKTDSCEGDSGGPLVCSLQGRMTLTGIVSWGDGCALKDKPGVYTRVSHFLPWIRSHTKEENGLAL

SEQ ID NO: 458 - protein, 251 aa, synthetic construct
  REGION 1..251: note = UROKINASE-TYPE PLASMINOGEN ACTIVATOR (u-PA) protease domain R36H/V38D/Y40I/V41A/D97E/A98G/T97adel/H99L/L97bdel /C122S/Y151M/Q192L/R217D
IIGGEFTTIENQPWFAAIYRHHRGGSDTIACGGSLISPCWVISATHCFIDYPKKEDYIVYLGRSRLNSNTQGEMKFEVENLILHKDYSAEGLHNDIALLKIRSKEGRCAQPSRTIQTISLPSMYNDPQFGTSCEITGFGKENSTDYLMPEQLKMTVVKLISHRECQQPHYYGSEVTTKMLCAADPQWKTDSCLGDSGGPLVCSLQGRMTLTGIVSWGDGCALKDKPGVYTRVSHFLPWIRSHTKEENGLAL

SEQ ID NO: 459 - protein, 251 aa, synthetic construct
  REGION 1..251: note = UROKINASE-TYPE PLASMINOGEN ACTIVATOR (u-PA) protease domain R36H/V38D/Y40H/V41M/D97E/A98G/T97adel/H99L/L97bdel /C122S/R217D
IIGGEFTTIENQPWFAAIYRHHRGGSDTHMCGGSLISPCWVISATHCFIDYPKKEDYIVYLGRSRLNSNTQGEMKFEVENLILHKDYSAEGLHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGDGCALKDKPGVYTRVSHFLPWIRSHTKEENGLAL

SEQ ID NO: 460 - protein, 251 aa, synthetic construct
  REGION 1..251: note = UROKINASE-TYPE PLASMINOGEN ACTIVATOR (u-PA) protease domain F30Y/R36H/V38D/V41K/D97E/T97adel/A98G/L97bdel/H99L /C122S/R217D
IIGGEFTTIENQPWYAAIYRHHRGGSDTYKCGGSLISPCWVISATHCFIDYPKKEDYIVYLGRSRLNSNTQGEMKFEVENLILHKDYSAEGLHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGDGCALKDKPGVYTRVSHFLPWIRSHTKEENGLAL

SEQ ID NO: 461 - protein, 251 aa, synthetic construct
  REGION 1..251: note = UROKINASE-TYPE PLASMINOGEN ACTIVATOR (u-PA) protease domain R36H/V38D/V41K/D97E/A98G/T97adel/H99L/L97bdel/C122 S/V213A/R217D
IIGGEFTTIENQPWFAAIYRHHRGGSDTYKCGGSLISPCWVISATHCFIDYPKKEDYIVYLGRSRLNSNTQGEMKFEVENLILHKDYSAEGLHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIASWGDGCALKDKPGVYTRVSHFLPWIRSHTKEENGLAL

SEQ ID NO: 462 - protein, 251 aa, synthetic construct
  REGION 1..251: note = UROKINASE-TYPE PLASMINOGEN ACTIVATOR (u-PA) protease domain R36H/V38D/V41M/F59I/D97E/T97adel/A98G/L97bdel/H99L /C122S/R217D
IIGGEFTTIENQPWFAAIYRHHRGGSDTYMCGGSLISPCWVISATHCIIDYPKKEDYIVYLGRSRLNSNTQGEMKFEVENLILHKDYSAEGLHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGDGCALKDKPGVYTRVSHFLPWIRSHTKEENGLAL

SEQ ID NO: 463 - protein, 251 aa, synthetic construct
  REGION 1..251: note = UROKINASE-TYPE PLASMINOGEN ACTIVATOR (u-PA) protease domain R36H/V38D/V41M/A55S/D97E/A98G/T97adel/H99L/L97bdel /C122S/R217D
IIGGEFTTIENQPWFAAIYRHHRGGSDTYMCGGSLISPCWVISSTHCFIDYPKKEDYIVYLGRSRLNSNTQGEMKFEVENLILHKDYSAEGLHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGDGCALKDKPGVYTRVSHFLPWIRSHTKEENGLAL

SEQ ID NO: 464 - protein, 252 aa, synthetic construct
  REGION 1..252: note = UROKINASE-TYPE PLASMINOGEN ACTIVATOR (u-PA) protease domain R36H/V38D/V41R/A96D/D97G/T97aN/A98G/L97bdel/H99L/C 122S/G193R/R217F
IIGGEFTTIENQPWFAAIYRHHRGGSDTYRCGGSLISPCWVISATHCFIDYPKKEDYIVYLGRSRLNSNTQGEMKFEVENLILHKDYSDGNGLHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQRDSGGPLVCSLQGRMTLTGIVSWGFGCALKDKPGVYTRVSHFLPWIRSHTKEENGLAL

SEQ ID NO: 465 - protein, 252 aa, synthetic construct
  REGION 1..252: note = UROKINASE-TYPE PLASMINOGEN ACTIVATOR (u-PA) protease domain R36H/V38D/V41R/A96D/D97G/T97aN/A98G/L97bdel/H99L/C 122S/Q192R/R217F
IIGGEFTTIENQPWFAAIYRHHRGGSDTYRCGGSLISPCWVISATHCFIDYPKKEDYIVYLGRSRLNSNTQGEMKFEVENLILHKDYSDGNGLHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCRGDSGGPLVCSLQGRMTLTGIVSWGFGCALKDKPGVYTRVSHFLPWIRSHTKEENGLAL

SEQ ID NO: 466 - protein, 251 aa, synthetic construct
  REGION 1..251: note = UROKINASE-TYPE PLASMINOGEN ACTIVATOR (u-PA) protease domain R36H/G37cD/V38D/V41R/A96D/D97G/A98G/T97adel/H99L/L 97bdel/C122S/M157T/R217D
IIGGEFTTIENQPWFAAIYRHHRGDSDTYRCGGSLISPCWVISATHCFIDYPKKEDYIVYLGRSRLNSNTQGEMKFEVENLILHKDYSDGGLHNDIALLKIRSKEGRCAQPSRTIQTISLPSMYNDPQFGTSCEITGFGKENSTDYLYPEQLKTTVVKLISHRECQQPHYYGSEVTTKMLCAADPQWKTDSCQGDSGGPLVCSLQGRMTLTGIVSWGDGCALKDKPGVYTRVSHFLPWIRSHTKEENGLAL

SEQ ID NO: 467 - protein, 251 aa, synthetic construct
  REGION 1..251: note = UROKINASE-TYPE PLASMINOGEN ACTIVATOR (u-PA) protease domain V38D/V41R/A96D/D97G/A98G/T97adel/H99L/L97bdel/C122 S/Q192R/R217D
IIGGEFTTIENQPWFAAIYRRHRGGSDTYRCGGSLISPCWVISATHCFIDYPKKEDYIVYLGRSRLNSNTQGEMKFEVENLILHKDYSDGGLHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCRGDSGGPLVCSLQGRMTLTGIVSWGDGCALKDKPGVYTRVSHFLPWIRSHTKEENGLAL

SEQ ID NO: 468 - protein, 251 aa, synthetic construct
  REGION 1..251: note = UROKINASE-TYPE PLASMINOGEN ACTIVATOR (u-PA) protease domain F21S/R36H/V38D/V41R/A96D/D97G/A98G/T97adel/H99L/L9 7bdel/C122S/E175D/R217D
IIGGESTTIENQPWFAAIYRHHRGGSDTYRCGGSLISPCWVISATHCFIDYPKKEDYIVYLGRSRLNSNTQGEMKFEVENLILHKDYSDGGLHNDIALLKIRSKEGRCAQPSRTIQTISLPSMYNDPQFGTSCEITGFGKENSTDYLYPEQLKMTVVKLISHRECQQPHYYGSDVTTKMLCAADPQWKTDSCQGDSGGPLVCSLQGRMTLTGIVSWGDGCALKDKPGVYTRVSHFLPWIRSHTKEENGLAL

SEQ ID NO: 469 - protein, 251 aa, synthetic construct
  REGION 1..251: note = UROKINASE-TYPE PLASMINOGEN ACTIVATOR (u-PA) protease domain R36H/V38D/V41R/A96D/D97E/A98G/T97adel/H99L/L97bdel /C122S/T178S/R217D
IIGGEFTTIENQPWFAAIYRHHRGGSDTYRCGGSLISPCWVISATHCFIDYPKKEDYIVYLGRSRLNSNTQGEMKFEVENLILHKDYSDEGLHNDIALLKIRSKEGRCAQPSRTIQTISLPSMYNDPQFGTSCEITGFGKENSTDYLYPEQLKMTVVKLISHRECQQPHYYGSEVTSKMLCAADPQWKTDSCQGDSGGPLVCSLQGRMTLTGIVSWGDGCALKDKPGVYTRVSHFLPWIRSHTKEENGLAL

SEQ ID NO: 470 - protein, 251 aa, synthetic construct
  REGION 1..251: note = UROKINASE-TYPE PLASMINOGEN ACTIVATOR (u-PA) protease domain R36H/V38D/V41R/A96D/D97E/A98G/T97adel/H99L/L97bdel /C122S/G193R/R217D
IIGGEFTTIENQPWFAAIYRHHRGGSDTYRCGGSLISPCWVISATHCFIDYPKKEDYIVYLGRSRLNSNTQGEMKFEVENLILHKDYSDEGLHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQRDSGGPLVCSLQGRMTLTGIVSWGDGCALKDKPGVYTRVSHFLPWIRSHTKEENGLAL

SEQ ID NO: 471 - protein, 253 aa, synthetic construct
  REGION 1..253: note = UROKINASE-TYPE PLASMINOGEN ACTIVATOR (u-PA) protease domain F30H/V38D/V41R/L97bA/H99Q/C122S/M157E
IIGGEFTTIENQPWHAAIYRRHRGGSDTYRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKETVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 472 - protein, 253 aa, synthetic construct
  REGION 1..253: note = UROKINASE-TYPE PLASMINOGEN ACTIVATOR (u-PA) protease domain F30H/V38D/V41R/L97bA/H99Q/C122S/Y151F/M157K/Q192W
IIGGEFTTIENQPWHAAIYRRHRGGSDTYRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLFPEQLKKTVVKLISHRECQQPHYYGSEVTTKMLCAADPQWKTDSCWGDSGGPLVCSLQGRMTLTGIVSWGRGCALKDKPGVYTRVSHFLPWIRSHTKEENGLAL

SEQ ID NO: 473 - protein, 253 aa, synthetic construct
  REGION 1..253: note = UROKINASE-TYPE PLASMINOGEN ACTIVATOR (u-PA) protease domain F30Y/V38D/Y40H/V41A/L97bA/H99Q/C122S/M157R
IIGGEFTTIENQPWYAAIYRRHRGGSDTHACGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKRTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 474 - protein, 253 aa, synthetic construct
  REGION 1..253: note = UROKINASE-TYPE PLASMINOGEN ACTIVATOR (u-PA) protease domain F30H/V38D/Y40F/V41R/L97bA/H99Q/C122S/Y151R/M157K
IIGGEFTTIENQPWHAAIYRRHRGGSDTFRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLRPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 475 - protein, 253 aa, synthetic construct
  REGION 1..253: note = UROKINASE-TYPE PLASMINOGEN ACTIVATOR (u-PA) protease domain F30H/V38D/Y40F/V41R/L97bA/H99Q/C122S/Y151L/M157F
IIGGEFTTIENQPWHAAIYRRHRGGSDTFRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLLPEQLKFTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 476 - protein, 253 aa, synthetic construct
  REGION 1..253: note = UROKINASE-TYPE PLASMINOGEN ACTIVATOR (u-PA) protease domain F30Y/V38D/Y40H/V41N/L97bA/H99Q/C122S
IIGGEFTTIENQPWYAAIYRRHRGGSDTHNCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 477 - protein, 253 aa, synthetic construct
  REGION 1..253: note = UROKINASE-TYPE PLASMINOGEN ACTIVATOR (u-PA) protease domain F30S/V38D/V41R/L97bA/H99Q/C122S/Y151L/M157K
IIGGEFTTIENQPWSAAIYRRHRGGSDTYRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLLPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 478 - protein, 253 aa, synthetic construct
  REGION 1..253: note = UROKINASE-TYPE PLASMINOGEN ACTIVATOR (u-PA) protease domain F30Y/V38D/Y40L/V41R/L97bA/H99Q/C122S/M157R
IIGGEFTTIENQPWYAAIYRRHRGGSDTLRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKRTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 479 - protein, 253 aa, synthetic construct
  REGION 1..253: note = UROKINASE-TYPE PLASMINOGEN ACTIVATOR (u-PA) protease domain F30Y/R36H/V38D/Y40F/V41R/L97bA/H99Q/C122S/Y151M/M1 57Y/Q192A
IIGGEFTTIENQPWYAAIYRHHRGGSDTFRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLMPEQLKYTVVKLISHRECQQPHYYGSEVTTKMLCAADPQWKTDSCAGDSGGPLVCSLQGRMTLTGIVSWGRGCALKDKPGVYTRVSHFLPWIRSHTKEENGLAL

SEQ ID NO: 480 - protein, 253 aa, synthetic construct
  REGION 1..253: note = UROKINASE-TYPE PLASMINOGEN ACTIVATOR (u-PA) protease domain F30Y/V38D/Y40L/V41R/L97bA/H99Q/C122S/Y151L/M157T/Q 192L
IIGGEFTTIENQPWYAAIYRRHRGGSDTLRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLLPEQLKTTVVKLISHRECQQPHYYGSEVTTKMLCAADPQWKTDSCLGDSGGPLVCSLQGRMTLTGIVSWGRGCALKDKPGVYTRVSHFLPWIRSHTKEENGLAL

SEQ ID NO: 481 - protein, 253 aa, synthetic construct
  REGION 1..253: note = UROKINASE-TYPE PLASMINOGEN ACTIVATOR (u-PA) protease domain F30H/V38D/V41R/L97bA/H99Q/C122S/Y151L/M157S
IIGGEFTTIENQPWHAAIYRRHRGGSDTYRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLLPEQLKSTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 482 - protein, 253 aa, synthetic construct
  REGION 1..253: note = UROKINASE-TYPE PLASMINOGEN ACTIVATOR (u-PA) protease domain F30Y/V38D/Y40H/V41K/L97bA/H99Q/C122S/Y151R/M157R
IIGGEFTTIENQPWYAAIYRRHRGGSDTHKCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLRPEQLKRTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 483 - protein, 253 aa, synthetic construct
  REGION 1..253: note = UROKINASE-TYPE PLASMINOGEN ACTIVATOR (u-PA) protease domain F30Y/V38D/Y40M/V41R/L97bA/H99Q/C122S
IIGGEFTTIENQPWYAAIYRRHRGGSDTMRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 484 - protein, 253 aa, synthetic construct
  REGION 1..253: note = UROKINASE-TYPE PLASMINOGEN ACTIVATOR (u-PA) protease domain F30H/V38D/V41R/L97bA/H99Q/C122S/Y151L/M157K
IIGGEFTTIENQPWHAAIYRRHRGGSDTYRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLLPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 485 - protein, 253 aa, synthetic construct
  REGION 1..253: note = UROKINASE-TYPE PLASMINOGEN ACTIVATOR (u-PA) protease domain F30Y/V38D/Y40H/V41R/L97bA/H99Q/C122S
IIGGEFTTIENQPWYAAIYRRHRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 486 - protein, 253 aa, synthetic construct
  REGION 1..253: note = UROKINASE-TYPE PLASMINOGEN ACTIVATOR (u-PA) protease domain F30H/V38D/V41R/A96G/L97bA/H99Q/C122S/Y151L/M157K
IIGGEFTTIENQPWHAAIYRRHRGGSDTYRCGGSLISPCWVISATHCFIDYPKKEDYIVYLGRSRLNSNTQGEMKFEVENLILHKDYSGDTAAQHNDIALLKIRSKEGRCAQPSRTIQTISLPSMYNDPQFGTSCEITGFGKENSTDYLLPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 487 - protein, 253 aa, synthetic construct
  REGION 1..253: note = UROKINASE-TYPE PLASMINOGEN ACTIVATOR (u-PA) protease domain F30H/G37bD/V38D/T39H/V41R/L97bA/H99Q/R110dH/C122S/ Y151L/M157K/S240I
IIGGEFTTIENQPWHAAIYRRHRDGSDHYRCGGSLISPCWVISATHCFIDYPKKEDYIVYLGRSRLNSNTQGEMKFEVENLILHKDYSADTAAQHNDIALLKIRSKEGHCAQPSRTIQTISLPSMYNDPQFGTSCEITGFGKENSTDYLLPEQLKKTVVKLISHRECQQPHYYGSEVTTKMLCAADPQWKTDSCQGDSGGPLVCSLQGRMTLTGIVSWGRGCALKDKPGVYTRVSHFLPWIRIHTKEENGLAL

SEQ ID NO: 488 - protein, 253 aa, synthetic construct
  REGION 1..253: note = UROKINASE-TYPE PLASMINOGEN ACTIVATOR (u-PA) protease domain F30H/V38D/V41R/L97bA/H99Q/C122S/Y149N/Y151L/M157K/ R239H
IIGGEFTTIENQPWHAAIYRRHRGGSDTYRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDNLLPEQLKKTVVKLISHRECQQPHYYGSEVTTKMLCAADPQWKTDSCQGDSGGPLVCSLQGRMTLTGIVSWGRGCALKDKPGVYTRVSHFLPWIHSHTKEENGLAL

SEQ ID NO: 489 - protein, 253 aa, synthetic construct
  REGION 1..253: note = UROKINASE-TYPE PLASMINOGEN ACTIVATOR (u-PA) protease domain F30Y/A32E/V38D/Y40H/V41R/L97bA/H99Q/C122S/M157K
IIGGEFTTIENQPWYAEIYRRHRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 490 - protein, 253 aa, synthetic construct
  REGION 1..253: note = UROKINASE-TYPE PLASMINOGEN ACTIVATOR (u-PA) protease domain F30Y/R37aH/V38D/Y40L/V41R/L97bA/H99Q/R110dH/C122S/ M157K/V160I
IIGGEFTTIENQPWYAAIYRRHHGGSDTLRCGGSLISPCWVISATHCFIDYPKKEDYIVYLGRSRLNSNTQGEMKFEVENLILHKDYSADTAAQHNDIALLKIRSKEGHCAQPSRTIQTISLPSMYNDPQFGTSCEITGFGKENSTDYLYPEQLKKTVIKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 491 - protein, 253 aa, synthetic construct
  REGION 1..253: note = UROKINASE-TYPE PLASMINOGEN ACTIVATOR (u-PA) protease domain F30Y/A32E/Y34N/V38D/Y40H/V41R/L97bA/H99Q/C122S/M15 7K
IIGGEFTTIENQPWYAEINRRHRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 492 - protein, 253 aa, synthetic construct
  REGION 1..253: note = UROKINASE-TYPE PLASMINOGEN ACTIVATOR (u-PA) protease domain F30Y/R37aH/V38D/Y40L/V41R/L97bA/H99Q/C122S/M157K
IIGGEFTTIENQPWYAAIYRRHHGGSDTLRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 493 - protein, 253 aa, synthetic construct
  REGION 1..253: note = UROKINASE-TYPE PLASMINOGEN ACTIVATOR (u-PA) protease domain F30Y/V38D/V41R/L97bA/H99Q/C122S/M157K
IIGGEFTTIENQPWYAAIYRRHRGGSDTYRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 494 - protein, 253 aa, synthetic construct
  REGION 1..253: note = UROKINASE-TYPE PLASMINOGEN ACTIVATOR (u-PA) protease domain F30Y/R35H/V38D/Y40H/V41R/T56A/L97bA/H99Q/C122S/M15 7K
IIGGEFTTIENQPWYAAIYHRHRGGSDTHRCGGSLISPCWVISAAHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 495 - protein, 253 aa, synthetic construct
  REGION 1..253: note = UROKINASE-TYPE PLASMINOGEN ACTIVATOR (u-PA) protease domain F30Y/V38D/Y40H/V41R/L97bA/H99Q/C122S/M157K/T158A
IIGGEFTTIENQPWYAAIYRRHRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKKAVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 496 - protein, 253 aa, synthetic construct
  REGION 1..253: note = UROKINASE-TYPE PLASMINOGEN ACTIVATOR (u-PA) protease domain F30Y/V38E/Y40H/V41R/T56A/L97bA/H99Q/C122S/M157K/K2 43M
IIGGEFTTIENQPWYAAIYRRHRGGSETHRCGGSLISPCWVISAAHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTMEENGLAL

SEQ ID NO: 497 - protein, 253 aa, synthetic construct
  REGION 1..253: note = UROKINASE-TYPE PLASMINOGEN ACTIVATOR (u-PA) protease domain F30Y/Y34N/V38D/Y40H/V41R/Y94F/S95R/L97bA/H99Q/C122 S/M157K/T242I
IIGGEFTTIENQPWYAAINRRHRGGSDTHRCGGSLISPCWVISATHCFIDYPKKEDYIVYLGRSRLNSNTQGEMKFEVENLILHKDFRADTAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHIKEENGLAL

SEQ ID NO: 498 - protein, 253 aa, synthetic construct
  REGION 1..253: note = UROKINASE-TYPE PLASMINOGEN ACTIVATOR (u-PA) protease domain F30Y/R36H/V38E/Y40H/V41R/T97aI/L97bA/H99Q/C122S/M1 57K
IIGGEFTTIENQPWYAAIYRHHRGGSETHRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 499 - protein, 253 aa, synthetic construct
  REGION 1..253: note = UROKINASE-TYPE PLASMINOGEN ACTIVATOR (u-PA) protease domain F30Y/R35H/V38D/T39S/Y40H/V41R/S75P/L97bA/H99Q/C122 S/M157K/I163M/Q204H/K243E
IIGGEFTTIENQPWYAAIYHRHRGGSDSHRCGGSLISPCWVISATHCFIDYPKKEDYIVYLGRSRLNPNTQGEMKFEVENLILHKDYSADTAAQHNDIALLKIRSKEGRCAQPSRTIQTISLPSMYNDPQFGTSCEITGFGKENSTDYLYPEQLKKTVVKLMSHRECQQPHYYGSEVTTKMLCAADPQWKTDSCQGDSGGPLVCSLHGRMTLTGIVSWGRGCALKDKPGVYTRVSHFLPWIRSHTEEENGLAL

SEQ ID NO: 500 - protein, 253 aa, synthetic construct
  REGION 1..253: note = UROKINASE-TYPE PLASMINOGEN ACTIVATOR (u-PA) protease domain F30Y/R35H/V38D/T39S/Y40L/V41R/L97bA/H99Q/C122S/T14 7S/M157K
IIGGEFTTIENQPWYAAIYHRHRGGSDSLRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSSDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 501 - protein, 253 aa, synthetic construct
  REGION 1..253: note = UROKINASE-TYPE PLASMINOGEN ACTIVATOR (u-PA) protease domain F30Y/R36S/V38H/Y40L/V41R/N76K/L97bA/H99Q/C122S/M15 7K
IIGGEFTTIENQPWYAAIYRSHRGGSHTLRCGGSLISPCWVISATHCFIDYPKKEDYIVYLGRSRLNSKTQGEMKFEVENLILHKDYSADTAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 502 - protein, 253 aa, synthetic construct
  REGION 1..253: note = UROKINASE-TYPE PLASMINOGEN ACTIVATOR (u-PA) protease domain F30H/V38D/V41R/L73Q/L97bA/H99Q/E110bD/C122S/Y149N/ Y151L/M157K
IIGGEFTTIENQPWHAAIYRRHRGGSDTYRCGGSLISPCWVISATHCFIDYPKKEDYIVYLGRSRQNSNTQGEMKFEVENLILHKDYSADTAAQHNDIALLKIRSKDGRCAQPSRTIQTISLPSMYNDPQFGTSCEITGFGKENSTDNLLPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 503 - protein, 253 aa, synthetic construct
  REGION 1..253: note = UROKINASE-TYPE PLASMINOGEN ACTIVATOR (u-PA) protease domain F30H/R36L/V38E/V41R/K82R/L97bA/H99Q/C122S/Y151L/M1 57K
IIGGEFTTIENQPWHAAIYRLHRGGSETYRCGGSLISPCWVISATHCFIDYPKKEDYIVYLGRSRLNSNTQGEMRFEVENLILHKDYSADTAAQHNDIALLKIRSKEGRCAQPSRTIQTISLPSMYNDPQFGTSCEITGFGKENSTDYLLPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 504 - protein, 253 aa, synthetic construct
  REGION 1..253: note = UROKINASE-TYPE PLASMINOGEN ACTIVATOR (u-PA) protease domain F30H/R35H/V38D/V41R/K61E/L97bA/H99Q/C122S/Y151L/M1 57K/R206H
IIGGEFTTIENQPWHAAIYHRHRGGSDTYRCGGSLISPCWVISATHCFIDYPEKEDYIVYLGRSRLNSNTQGEMKFEVENLILHKDYSADTAAQHNDIALLKIRSKEGRCAQPSRTIQTISLPSMYNDPQFGTSCEITGFGKENSTDYLLPEQLKKTVVKLISHRECQQPHYYGSEVTTKMLCAADPQWKTDSCQGDSGGPLVCSLQGHMTLTGIVSWGRGCALKDKPGVYTRVSHFLPWIRSHTKEENGLAL

SEQ ID NO: 505 - protein, 253 aa, synthetic construct
  REGION 1..253: note = UROKINASE-TYPE PLASMINOGEN ACTIVATOR (u-PA) protease domain I17V/F30H/V38D/V41R/L97bA/H99Q/C122S/Y151L/M157K
IVGGEFTTIENQPWHAAIYRRHRGGSDTYRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLLPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 506 - protein, 253 aa, synthetic construct
  REGION 1..253: note = UROKINASE-TYPE PLASMINOGEN ACTIVATOR (u-PA) protease domain F30H/R35S/V38E/V41R/Y60bH/L97bA/H99Q/C122S/Y151L/M 157K
IIGGEFTTIENQPWHAAIYSRHRGGSETYRCGGSLISPCWVISATHCFIDHPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLLPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 507 - protein, 253 aa, synthetic construct
  REGION 1..253: note = UROKINASE-TYPE PLASMINOGEN ACTIVATOR (u-PA) protease domain F30H/R36H/V38D/V41R/T56A/L97bA/H99Q/C122S/Y151L/M1 57K
IIGGEFTTIENQPWHAAIYRHHRGGSDTYRCGGSLISPCWVISAAHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLLPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 508 - protein, 253 aa, synthetic construct
  REGION 1..253: note = UROKINASE-TYPE PLASMINOGEN ACTIVATOR (u-PA) protease domain F30H/R35Q/H37T/V38D/V41R/L97bA/H99Q/C122S/Y149I/Y1 51L/M157K/R217D
IIGGEFTTIENQPWHAAIYQRTRGGSDTYRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDILLPEQLKKTVVKLISHRECQQPHYYGSEVTTKMLCAADPQWKTDSCQGDSGGPLVCSLQGRMTLTGIVSWGDGCALKDKPGVYTRVSHFLPWIRSHTKEENGLAL

SEQ ID NO: 509 - protein, 253 aa, synthetic construct
  REGION 1..253: note = UROKINASE-TYPE PLASMINOGEN ACTIVATOR (u-PA) protease domain F30H/R35Q/H37W/V38D/V41R/D60aE/Y60bS/L97bA/H99Q/C1 22S/Y149L/Y151L/M157K
IIGGEFTTIENQPWHAAIYQRWRGGSDTYRCGGSLISPCWVISATHCFIESPKKEDYIVYLGRSRLNSNTQGEMKFEVENLILHKDYSADTAAQHNDIALLKIRSKEGRCAQPSRTIQTISLPSMYNDPQFGTSCEITGFGKENSTDLLLPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 510 - protein, 253 aa, synthetic construct
  REGION 1..253: note = UROKINASE-TYPE PLASMINOGEN ACTIVATOR (u-PA) protease domain F30H/R35Q/H37Q/V38D/V41R/A96D/L97bA/H99Q/C122S/Y14 9L/Y151L/M157K/R217D
IIGGEFTTIENQPWHAAIYQRQRGGSDTYRCGGSLISPCWVISATHCFIDYPKKEDYIVYLGRSRLNSNTQGEMKFEVENLILHKDYSDDTAAQHNDIALLKIRSKEGRCAQPSRTIQTISLPSMYNDPQFGTSCEITGFGKENSTDLLLPEQLKKTVVKLISHRECQQPHYYGSEVTTKMLCAADPQWKTDSCQGDSGGPLVCSLQGRMTLTGIVSWGDGCALKDKPGVYTRVSHFLPWIRSHTKEENGLAL

SEQ ID NO: 511 - protein, 253 aa, synthetic construct
  REGION 1..253: note = UROKINASE-TYPE PLASMINOGEN ACTIVATOR (u-PA) protease domain F30H/R35H/H37I/V38D/V41R/L97bA/H99Q/C122S/Y149W/Y1 51L/M157K/R217S
IIGGEFTTIENQPWHAAIYHRIRGGSDTYRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDWLLPEQLKKTVVKLISHRECQQPHYYGSEVTTKMLCAADPQWKTDSCQGDSGGPLVCSLQGRMTLTGIVSWGSGCALKDKPGVYTRVSHFLPWIRSHTKEENGLAL

SEQ ID NO: 512 - protein, 253 aa, synthetic construct
  REGION 1..253: note = UROKINASE-TYPE PLASMINOGEN ACTIVATOR (u-PA) protease domain F30H/R35T/H37M/V38D/V41R/D60aS/Y60bT/L97bA/H99Q/A1 12V/C122S/Y151L/M157K/R217T
IIGGEFTTIENQPWHAAIYTRMRGGSDTYRCGGSLISPCWVISATHCFISTPKKEDYIVYLGRSRLNSNTQGEMKFEVENLILHKDYSADTAAQHNDIALLKIRSKEGRCVQPSRTIQTISLPSMYNDPQFGTSCEITGFGKENSTDYLLPEQLKKTVVKLISHRECQQPHYYGSEVTTKMLCAADPQWKTDSCQGDSGGPLVCSLQGRMTLTGIVSWGTGCALKDKPGVYTRVSHFLPWIRSHTKEENGLAL

SEQ ID NO: 513 - protein, 253 aa, synthetic construct
  REGION 1..253: note = UROKINASE-TYPE PLASMINOGEN ACTIVATOR (u-PA) protease domain F30H/R35Q/H37W/V38D/V41R/L97bA/H99Q/C122S/Y151L/M1 57K
IIGGEFTTIENQPWHAAIYQRWRGGSDTYRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLLPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 514 - protein, 253 aa, synthetic construct
  REGION 1..253: note = UROKINASE-TYPE PLASMINOGEN ACTIVATOR (u-PA) protease domain F30H/R35L/H37D/V38D/V41R/L97bA/H99Q/C122S/Y151L/M1 57K/R217E
IIGGEFTTIENQPWHAAIYLRDRGGSDTYRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLLPEQLKKTVVKLISHRECQQPHYYGSEVTTKMLCAADPQWKTDSCQGDSGGPLVCSLQGRMTLTGIVSWGEGCALKDKPGVYTRVSHFLPWIRSHTKEENGLAL

SEQ ID NO: 515 - protein, 253 aa, synthetic construct
  REGION 1..253: note = UROKINASE-TYPE PLASMINOGEN ACTIVATOR (u-PA) protease domain F30H/R35Q/H37T/V38D/V41R/L97bA/H99Q/C122S/Y151L/M1 57K
IIGGEFTTIENQPWHAAIYQRTRGGSDTYRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLLPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 516 - protein, 253 aa, synthetic construct
  REGION 1..253: note = UROKINASE-TYPE PLASMINOGEN ACTIVATOR (u-PA) protease domain F30H/R35Q/V38D/V41R/L97bA/H99Q/C122S/Y151L/M157K
IIGGEFTTIENQPWHAAIYQRHRGGSDTYRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLLPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 517 - protein, 253 aa, synthetic construct
  REGION 1..253: note = UROKINASE-TYPE PLASMINOGEN ACTIVATOR (u-PA) protease domain F30H/R35Q/H37W/V38D/V41R/D60aE/L97bA/H99Q/C122S/Y1 49L/Y151L/M157K/R217D
IIGGEFTTIENQPWHAAIYQRWRGGSDTYRCGGSLISPCWVISATHCFIEYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDLLLPEQLKKTVVKLISHRECQQPHYYGSEVTTKMLCAADPQWKTDSCQGDSGGPLVCSLQGRMTLTGIVSWGDGCALKDKPGVYTRVSHFLPWIRSHTKEENGLAL

SEQ ID NO: 518 - protein, 253 aa, synthetic construct
  REGION 1..253: note = UROKINASE-TYPE PLASMINOGEN ACTIVATOR (u-PA) protease domain F30H/R35Q/V38D/V41R/Y60bE/L97bA/H99Q/C122S/Y149N/Y 151L/M157K
IIGGEFTTIENQPWHAAIYQRHRGGSDTYRCGGSLISPCWVISATHCFIDEPKKEDYIVYLGRSRLNSNTQGEMKFEVENLILHKDYSADTAAQHNDIALLKIRSKEGRCAQPSRTIQTISLPSMYNDPQFGTSCEITGFGKENSTDNLLPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 519 - protein, 253 aa, synthetic construct
  REGION 1..253: note = UROKINASE-TYPE PLASMINOGEN ACTIVATOR (u-PA) protease domain F30Y/R35Q/V38D/Y40H/V41R/L97bA/H99Q/C122S/Y149W/M1 57K/R217D
IIGGEFTTIENQPWYAAIYQRHRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDWLYPEQLKKTVVKLISHRECQQPHYYGSEVTTKMLCAADPQWKTDSCQGDSGGPLVCSLQGRMTLTGIVSWGDGCALKDKPGVYTRVSHFLPWIRSHTKEENGLAL

SEQ ID NO: 520 - protein, 253 aa, synthetic construct
  REGION 1..253: note = UROKINASE-TYPE PLASMINOGEN ACTIVATOR (u-PA) protease domain F30Y/R35Q/H37W/V38D/Y40H/V41R/Y60bN/L97bA/H99Q/C12 2S/Y149H/M157K
IIGGEFTTIENQPWYAAIYQRWRGGSDTHRCGGSLISPCWVISATHCFIDNPKKEDYIVYLGRSRLNSNTQGEMKFEVENLILHKDYSADTAAQHNDIALLKIRSKEGRCAQPSRTIQTISLPSMYNDPQFGTSCEITGFGKENSTDHLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 521 - protein, 253 aa, synthetic construct
  REGION 1..253: note = UROKINASE-TYPE PLASMINOGEN ACTIVATOR (u-PA) protease domain F30Y/R35Q/H37T/V38D/Y40H/V41R/L97bA/H99Q/C122S/Y14 9I/M157K
IIGGEFTTIENQPWYAAIYQRTRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDILYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 522 - protein, 253 aa, synthetic construct
  REGION 1..253: note = UROKINASE-TYPE PLASMINOGEN ACTIVATOR (u-PA) protease domain F30Y/R35Q/H37T/V38D/Y40H/V41R/D60aE/Y60bN/L97bA/H9 9Q/C122S/Y149H/M157K
IIGGEFTTIENQPWYAAIYQRTRGGSDTHRCGGSLISPCWVISATHCFIENPKKEDYIVYLGRSRLNSNTQGEMKFEVENLILHKDYSADTAAQHNDIALLKIRSKEGRCAQPSRTIQTISLPSMYNDPQFGTSCEITGFGKENSTDHLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 523 - protein, 253 aa, synthetic construct
  REGION 1..253: note = UROKINASE-TYPE PLASMINOGEN ACTIVATOR (u-PA) protease domain F30Y/R35H/V38D/Y40H/V41R/L97bA/H99Q/C122S/M157K
IIGGEFTTIENQPWYAAIYHRHRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 524 - protein, 253 aa, synthetic construct
  REGION 1..253: note = UROKINASE-TYPE PLASMINOGEN ACTIVATOR (u-PA) protease domain F30Y/R35H/V38D/Y40H/V41R/T56A/L97bV/H99Q/R116S/C12 2S/M157K/T210N
IIGGEFTTIENQPWYAAIYHRHRGGSDTHRCGGSLISPCWVISAAHCFIDYPKKEDYIVYLGRSRLNSNTQGEMKFEVENLILHKDYSADTVAQHNDIALLKIRSKEGRCAQPSSTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLNGIVSWGRGCALKDKPGVYTRVSHFLPWIRSHTKEENGLAL

SEQ ID NO: 525 - protein, 253 aa, synthetic construct
  REGION 1..253: note = UROKINASE-TYPE PLASMINOGEN ACTIVATOR (u-PA) protease domain F30Y/R35Q/V38D/Y40H/V41R/L97bA/H99Q/C122S/E153D/M1 57K
IIGGEFTTIENQPWYAAIYQRHRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPDQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 526 - protein, 253 aa, synthetic construct
  REGION 1..253: note = UROKINASE-TYPE PLASMINOGEN ACTIVATOR (u-PA) protease domain F30Y/V38D/Y40H/V41R/L97bA/H99Q/C122S/D148N/M157K/T 188S
IIGGEFTTIENQPWYAAIYRRHRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTNYLYPEQLKKTVVKLISHRECQQPHYYGSEVTTKMLCAADPQWKSDSCQGDSGGPLVCSLQGRMTLTGIVSWGRGCALKDKPGVYTRVSHFLPWIRSHTKEENGLAL

SEQ ID NO: 527 - protein, 253 aa, synthetic construct
  REGION 1..253: note = UROKINASE-TYPE PLASMINOGEN ACTIVATOR (u-PA) protease domain F30Y/V38D/Y40H/V41R/L97bA/H99Q/C122S/M157K/K223N/P 236S
IIGGEFTTIENQPWYAAIYRRHRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALNDKPGVYTRVSHFLSWIRSHTKEENGLAL

SEQ ID NO: 528 - protein, 253 aa, synthetic construct
  REGION 1..253: note = UROKINASE-TYPE PLASMINOGEN ACTIVATOR (u-PA) protease domain F30Y/V38D/Y40M/V41R/L97bA/H99Q/C122S/Y151L/M157R/Q 192M
IIGGEFTTIENQPWYAAIYRRHRGGSDTMRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLLPEQLKRTVVKLISHRECQQPHYYGSEVTTKMLCAADPQWKTDSCMGDSGGPLVCSLQGRMTLTGIVSWGRGCALKDKPGVYTRVSHFLPWIRSHTKEENGLAL

SEQ ID NO: 529 - protein, 253 aa, synthetic construct
  REGION 1..253: note = UROKINASE-TYPE PLASMINOGEN ACTIVATOR (u-PA) protease domain F30H/V38D/L97bA/H99Q/C122S/Y151L/M157L/Q192H
IIGGEFTTIENQPWHAAIYRRHRGGSDTYVCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLLPEQLKLTVVKLISHRECQQPHYYGSEVTTKMLCAADPQWKTDSCHGDSGGPLVCSLQGRMTLTGIVSWGRGCALKDKPGVYTRVSHFLPWIRSHTKEENGLAL

SEQ ID NO: 530 - protein, 253 aa, synthetic construct
  REGION 1..253: note = UROKINASE-TYPE PLASMINOGEN ACTIVATOR (u-PA) protease domain F30H/V38D/L97bA/H99Q/C122S/Y151L/M157S/Q192L
IIGGEFTTIENQPWHAAIYRRHRGGSDTYVCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLLPEQLKSTVVKLISHRECQQPHYYGSEVTTKMLCAADPQWKTDSCLGDSGGPLVCSLQGRMTLTGIVSWGRGCALKDKPGVYTRVSHFLPWIRSHTKEENGLAL

SEQ ID NO: 531 - protein, 253 aa, synthetic construct
  REGION 1..253: note = UROKINASE-TYPE PLASMINOGEN ACTIVATOR (u-PA) protease domain F30N/V38D/Y40F/V41R/L97bA/H99Q/C122S/Y151L/M157S/Q 192H
IIGGEFTTIENQPWNAAIYRRHRGGSDTFRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLLPEQLKSTVVKLISHRECQQPHYYGSEVTTKMLCAADPQWKTDSCHGDSGGPLVCSLQGRMTLTGIVSWGRGCALKDKPGVYTRVSHFLPWIRSHTKEENGLAL

SEQ ID NO: 532 - protein, 253 aa, synthetic construct
  REGION 1..253: note = UROKINASE-TYPE PLASMINOGEN ACTIVATOR (u-PA) protease domain F30H/V38D/Y40H/V41Q/L97bA/H99Q/C122S/Q192H
IIGGEFTTIENQPWHAAIYRRHRGGSDTHQCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCHGDSGGPLVCSLQGRMTLTGIVSWGRGCALKDKPGVYTRVSHFLPWIRSHTKEENGLAL

SEQ ID NO: 533 - protein, 253 aa, synthetic construct
  REGION 1..253: note = UROKINASE-TYPE PLASMINOGEN ACTIVATOR (u-PA) protease domain F30Q/V38D/Y40L/V41R/L97bA/H99Q/C122S/Y151H/M157R/Q 192Y
IIGGEFTTIENQPWQAAIYRRHRGGSDTLRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLHPEQLKRTVVKLISHRECQQPHYYGSEVTTKMLCAADPQWKTDSCYGDSGGPLVCSLQGRMTLTGIVSWGRGCALKDKPGVYTRVSHFLPWIRSHTKEENGLAL

SEQ ID NO: 534 - protein, 253 aa, synthetic construct
  REGION 1..253: note = UROKINASE-TYPE PLASMINOGEN ACTIVATOR (u-PA) protease domain R35S/V38D/L97bA/H99Q/C122S/Y151L/M157Y
IIGGEFTTIENQPWFAAIYSRHRGGSDTYVCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLLPEQLKYTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 535 - protein, 253 aa, synthetic construct
  REGION 1..253: note = UROKINASE-TYPE PLASMINOGEN ACTIVATOR (u-PA) protease domain F30H/V38D/V41R/L97bA/H99Q/C122S/Y151L/M157T
IIGGEFTTIENQPWHAAIYRRHRGGSDTYRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLLPEQLKTTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 536 - protein, 253 aa, synthetic construct
  REGION 1..253: note = UROKINASE-TYPE PLASMINOGEN ACTIVATOR (u-PA) protease domain R37aL/V38D/L97bA/H99Q/C122S/Y151L/M157S
IIGGEFTTIENQPWFAAIYRRHLGGSDTYVCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLLPEQLKSTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 537 - protein, 253 aa, synthetic construct
  REGION 1..253: note = UROKINASE-TYPE PLASMINOGEN ACTIVATOR (u-PA) protease domain F30N/V38D/V41L/L97bA/H99Q/C122S/Y151L/M157R
IIGGEFTTIENQPWNAAIYRRHRGGSDTYLCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLLPEQLKRTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 538 - protein, 253 aa, synthetic construct
  REGION 1..253: note = UROKINASE-TYPE PLASMINOGEN ACTIVATOR (u-PA) protease domain F30Y/V38D/Y40F/V41L/L97bA/H99Q/C122S/Y151L/M157R
IIGGEFTTIENQPWYAAIYRRHRGGSDTFLCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLLPEQLKRTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 539 - protein, 253 aa, synthetic construct
  REGION 1..253: note = UROKINASE-TYPE PLASMINOGEN ACTIVATOR (u-PA) protease domain F30H/V38D/Y40F/V41R/L97bA/H99Q/C122S/Y151L/M157R/Q 192H
IIGGEFTTIENQPWHAAIYRRHRGGSDTFRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLLPEQLKRTVVKLISHRECQQPHYYGSEVTTKMLCAADPQWKTDSCHGDSGGPLVCSLQGRMTLTGIVSWGRGCALKDKPGVYTRVSHFLPWIRSHTKEENGLAL

SEQ ID NO: 540 - protein, 253 aa, synthetic construct
  REGION 1..253: note = UROKINASE-TYPE PLASMINOGEN ACTIVATOR (u-PA) protease domain F30Y/R36H/V38D/Y40H/V41R/L97bA/H99Q/C122S/M157K/T2 10S
IIGGEFTTIENQPWYAAIYRHHRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLSGIVSWGRGCALKDKPGVYTRVSHFLPWIRSHTKEENGLAL

SEQ ID NO: 541 - protein, 253 aa, synthetic construct
  REGION 1..253: note = UROKINASE-TYPE PLASMINOGEN ACTIVATOR (u-PA) protease domain F30H/V38D/L97bA/H99Q/C122S/Y151L/M157K
IIGGEFTTIENQPWHAAIYRRHRGGSDTYVCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLLPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 542 - protein, 253 aa, synthetic construct
  REGION 1..253: note = UROKINASE-TYPE PLASMINOGEN ACTIVATOR (u-PA) protease domain N26D/F30Y/V38D/Y40H/V41R/I65T/L97bA/H99Q/C122S/M12 6I/M157K
IIGGEFTTIEDQPWYAAIYRRHRGGSDTHRCGGSLISPCWVISATHCFIDYPKKEDYTVYLGRSRLNSNTQGEMKFEVENLILHKDYSADTAAQHNDIALLKIRSKEGRCAQPSRTIQTISLPSIYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 543 - protein, 253 aa, synthetic construct
  REGION 1..253: note = UROKINASE-TYPE PLASMINOGEN ACTIVATOR (u-PA) protease domain F30Y/V38D/Y40L/V41R/L97bA/H99Q/C122S/Y151L/M157K/Q 192H
IIGGEFTTIENQPWYAAIYRRHRGGSDTLRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLLPEQLKKTVVKLISHRECQQPHYYGSEVTTKMLCAADPQWKTDSCHGDSGGPLVCSLQGRMTLTGIVSWGRGCALKDKPGVYTRVSHFLPWIRSHTKEENGLAL

SEQ ID NO: 544 - protein, 253 aa, synthetic construct
  REGION 1..253: note = UROKINASE-TYPE PLASMINOGEN ACTIVATOR (u-PA) protease domain F30Y/V38D/Y40L/V41Q/L97bA/H99Q/C122S/Y151L/M157R/Q 192Y
IIGGEFTTIENQPWYAAIYRRHRGGSDTLQCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLLPEQLKRTVVKLISHRECQQPHYYGSEVTTKMLCAADPQWKTDSCYGDSGGPLVCSLQGRMTLTGIVSWGRGCALKDKPGVYTRVSHFLPWIRSHTKEENGLAL

SEQ ID NO: 545 - protein, 253 aa, synthetic construct
  REGION 1..253: note = UROKINASE-TYPE PLASMINOGEN ACTIVATOR (u-PA) protease domain F30Y/V38D/Y40L/V41R/L97bA/H99Q/C122S/Y151L/M157A/Q 192Y
IIGGEFTTIENQPWYAAIYRRHRGGSDTLRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLLPEQLKATVVKLISHRECQQPHYYGSEVTTKMLCAADPQWKTDSCYGDSGGPLVCSLQGRMTLTGIVSWGRGCALKDKPGVYTRVSHFLPWIRSHTKEENGLAL

SEQ ID NO: 546 - protein, 253 aa, synthetic construct
  REGION 1..253: note = UROKINASE-TYPE PLASMINOGEN ACTIVATOR (u-PA) protease domain F30Y/R36S/V38D/Y40H/V41R/L97bA/H99Q/C122S/M157K
IIGGEFTTIENQPWYAAIYRSHRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 547 - protein, 253 aa, synthetic construct
  REGION 1..253: note = UROKINASE-TYPE PLASMINOGEN ACTIVATOR (u-PA) protease domain F30H/V38D/V41Q/L97bA/H99Q/C122S/Y151L/M157R
IIGGEFTTIENQPWHAAIYRRHRGGSDTYQCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLLPEQLKRTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 548 - protein, 253 aa, synthetic construct
  REGION 1..253: note = UROKINASE-TYPE PLASMINOGEN ACTIVATOR (u-PA) protease domain F30H/V38D/L97bA/H99Q/C122S/Y151F/M157K
IIGGEFTTIENQPWHAAIYRRHRGGSDTYVCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLFPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 549 - protein, 253 aa, synthetic construct
  REGION 1..253: note = UROKINASE-TYPE PLASMINOGEN ACTIVATOR (u-PA) protease domain F30Y/R37aH/V38D/Y40H/V41R/K61E/L97bA/H99Q/C122S/M1 57K
IIGGEFTTIENQPWYAAIYRRHHGGSDTHRCGGSLISPCWVISATHCFIDYPEKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 550 - protein, 253 aa, synthetic construct
  REGION 1..253: note = UROKINASE-TYPE PLASMINOGEN ACTIVATOR (u-PA) protease domain F30Y/R36H/V38D/Y40H/V41R/L97bA/H99L/C122S/F141L/M1 57K/T158A
IIGGEFTTIENQPWYAAIYRHHRGGSDTHRCGGSLISPCWVISATHCFIDYPKKEDYIVYLGRSRLNSNTQGEMKFEVENLILHKDYSADTAALHNDIALLKIRSKEGRCAQPSRTIQTISLPSMYNDPQFGTSCEITGLGKENSTDYLYPEQLKKAVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 551 - protein, 253 aa, synthetic construct
  REGION 1..253: note = UROKINASE-TYPE PLASMINOGEN ACTIVATOR (u-PA) protease domain F30Y/R35H/V38D/Y40H/V41R/L97bA/H99Q/C122S/I138V/M1 57K
IIGGEFTTIENQPWYAAIYHRHRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEVTGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 552 - protein, 253 aa, synthetic construct
  REGION 1..253: note = UROKINASE-TYPE PLASMINOGEN ACTIVATOR (u-PA) protease domain T22I/F30Y/R35S/V38D/Y40H/V41R/L97bA/H99Q/C122S/I13 8V/M157K
IIGGEFITIENQPWYAAIYSRHRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEVTGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 553 - protein, 253 aa, synthetic construct
  REGION 1..253: note = UROKINASE-TYPE PLASMINOGEN ACTIVATOR (u-PA) protease domain F30Y/R36S/V38D/T39I/Y40H/V41R/L97bA/H99Q/C122S/S14 6P/M157K/T158S
IIGGEFTTIENQPWYAAIYRSHRGGSDIHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENPTDYLYPEQLKKSVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 554 - protein, 253 aa, synthetic construct
  REGION 1..253: note = UROKINASE-TYPE PLASMINOGEN ACTIVATOR (u-PA) protease domain F30Y/Y34S/R37aH/V38D/Y40H/V41R/L97bA/H99Q/C122S/Y1 49F/M157K
IIGGEFTTIENQPWYAAISRRHHGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDFLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 555 - protein, 253 aa, synthetic construct
  REGION 1..253: note = UROKINASE-TYPE PLASMINOGEN ACTIVATOR (u-PA) protease domain F30Y/R35L/V38D/Y40H/V41R/L97bA/H99Q/C122S/M157K
IIGGEFTTIENQPWYAAIYLRHRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 556 - protein, 253 aa, synthetic construct
  REGION 1..253: note = UROKINASE-TYPE PLASMINOGEN ACTIVATOR (u-PA) protease domain F30Y/S37dP/V38D/Y40H/V41R/L97bA/H99Q/C122S/M157K
IIGGEFTTIENQPWYAAIYRRHRGGPDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 557 - protein, 253 aa, synthetic construct
  REGION 1..253: note = UROKINASE-TYPE PLASMINOGEN ACTIVATOR (u-PA) protease domain F30Y/R35L/V38D/Y40H/V41R/L97bA/H99Q/C122S/M157K/T1 58A
IIGGEFTTIENQPWYAAIYLRHRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKKAVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 558 - protein, 253 aa, synthetic construct
  REGION 1..253: note = UROKINASE-TYPE PLASMINOGEN ACTIVATOR (u-PA) protease domain F30Y/R37aS/V38D/Y40H/V41R/E86D/L97bA/H99Q/C122S/M1 57K/F234Y
IIGGEFTTIENQPWYAAIYRRHSGGSDTHRCGGSLISPCWVISATHCFIDYPKKEDYIVYLGRSRLNSNTQGEMKFEVDNLILHKDYSADTAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHYLPWIRSHTKEENGLAL

SEQ ID NO: 559 - protein, 253 aa, synthetic construct
  REGION 1..253: note = UROKINASE-TYPE PLASMINOGEN ACTIVATOR (u-PA) protease domain F30Y/R37aH/V38D/Y40H/V41R/L97bA/H99Q/C122S/M157K/S 174P
IIGGEFTTIENQPWYAAIYRRHHGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKKTVVKLISHRECQQPHYYGPEVTTKMLCAADPQWKTDSCQGDSGGPLVCSLQGRMTLTGIVSWGRGCALKDKPGVYTRVSHFLPWIRSHTKEENGLAL

SEQ ID NO: 560 - protein, 253 aa, synthetic construct
  REGION 1..253: note = UROKINASE-TYPE PLASMINOGEN ACTIVATOR (u-PA) protease domain F30Y/R37aS/V38D/Y40H/V41R/L97bA/H99Q/C122S/M157K
IIGGEFTTIENQPWYAAIYRRHSGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 561 - protein, 253 aa, synthetic construct
  REGION 1..253: note = UROKINASE-TYPE PLASMINOGEN ACTIVATOR (u-PA) protease domain F30Y/R35L/V38D/Y40H/V41R/N76S/L97bA/H99Q/C122S/M15 7K/K187E
IIGGEFTTIENQPWYAAIYLRHRGGSDTHRCGGSLISPCWVISATHCFIDYPKKEDYIVYLGRSRLNSSTQGEMKFEVENLILHKDYSADTAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWETDSCQGDSGGPLVCSLQGRMTLTGIVSWGRGCALKDKPGVYTRVSHFLPWIRSHTKEENGLAL

SEQ ID NO: 562 - protein, 253 aa, synthetic construct
  REGION 1..253: note = UROKINASE-TYPE PLASMINOGEN ACTIVATOR (u-PA) protease domain F30Y/R35H/V38D/Y40H/V41R/L97bA/H99Q/C122S/M157K/T1 58S
IIGGEFTTIENQPWYAAIYHRHRGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKKSVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 563 - protein, 253 aa, synthetic construct
  REGION 1..253: note = UROKINASE-TYPE PLASMINOGEN ACTIVATOR (u-PA) protease domain F30Y/R37aS/V38D/Y40H/V41R/L97bA/H99Q/C122S/M157K/K 187Q/T208S
IIGGEFTTIENQPWYAAIYRRHSGGSDTHRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWQTDSCQGDSGGPLVCSLQGRMSLTGIVSWGRGCALKDKPGVYTRVSHFLPWIRSHTKEENGLAL

SEQ ID NO: 564 - protein, 253 aa, synthetic construct
  REGION 1..253: note = UROKINASE-TYPE PLASMINOGEN ACTIVATOR (u-PA) protease domain F30H/V38D/V41R/L97bA/H99Q/C122S/Y151L/M157K/Q192H/ R239H
IIGGEFTTIENQPWHAAIYRRHRGGSDTYRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLLPEQLKKTVVKLISHRECQQPHYYGSEVTTKMLCAADPQWKTDSCHGDSGGPLVCSLQGRMTLTGIVSWGRGCALKDKPGVYTRVSHFLPWIHSHTKEENGLAL

SEQ ID NO: 565 - protein, 253 aa, synthetic construct
  REGION 1..253: note = UROKINASE-TYPE PLASMINOGEN ACTIVATOR (u-PA) protease domain F30H/R35Q/H37Y/V38D/V41R/D60aE/Y60bN/L97bA/H99Q/C1 22S/Y149R/Y151L/M157K
IIGGEFTTIENQPWHAAIYQRYRGGSDTYRCGGSLISPCWVISATHCFIENPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLLPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 566 - protein, 253 aa, synthetic construct
  REGION 1..253: note = UROKINASE-TYPE PLASMINOGEN ACTIVATOR (u-PA) protease domain F30Y/R35T/H37Q/V38D/Y40H/V41R/D60aE/Y60bN/L97bA/H9 9Q/C122S/Y149R/M157K
IIGGEFTTIENQPWYAAIYTRQRGGSDTHRCGGSLISPCWVISATHCFIENPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 567 - protein, 253 aa, synthetic construct
  REGION 1..253: note = UROKINASE-TYPE PLASMINOGEN ACTIVATOR (u-PA) protease domain F30Y/R35T/V38D/Y40H/V41R/D60aE/Y60bQ/L97bA/H99Q/C1 22S/Y149R/M157K/R217K
IIGGEFTTIENQPWYAAIYTRHRGGSDTHRCGGSLISPCWVISATHCFIEQPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGKGCALKDKPGVYTRVSHFLPWIRSHTKEENGLAL

SEQ ID NO: 568 - protein, 253 aa, synthetic construct
  REGION 1..253: note = UROKINASE-TYPE PLASMINOGEN ACTIVATOR (u-PA) protease domain F30Y/R35K/H37E/V38D/Y40H/V41R/D60aP/Y60bD/L97bA/H9 9Q/C122S/Y149N/M157K
IIGGEFTTIENQPWYAAIYKRERGGSDTHRCGGSLISPCWVISATHCFIPDPKKEDYIVYLGRSRLNSNTQGEMKFEVENLILHKDYSADTAAQHNDIALLKIRSKEGRCAQPSRTIQTISLPSMYNDPQFGTSCEITGFGKENSTDNLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 569 - protein, 253 aa, synthetic construct
  REGION 1..253: note = UROKINASE-TYPE PLASMINOGEN ACTIVATOR (u-PA) protease domain F30Y/R35L/H37D/V38D/Y40H/V41R/Y60bD/L97bA/H99Q/C12 2S/Y149R/M157K
IIGGEFTTIENQPWYAAIYLRDRGGSDTHRCGGSLISPCWVISATHCFIDDPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 570 - protein, 253 aa, synthetic construct
  REGION 1..253: note = UROKINASE-TYPE PLASMINOGEN ACTIVATOR (u-PA) protease domain F30Y/R35H/H37T/V38D/Y40H/V41R/D60aE/Y60bD/L97bA/H9 9Q/C122S/Y149K/M157K/R217K
IIGGEFTTIENQPWYAAIYHRTRGGSDTHRCGGSLISPCWVISATHCFIEDPKKEDYIVYLGRSRLNSNTQGEMKFEVENLILHKDYSADTAAQHNDIALLKIRSKEGRCAQPSRTIQTISLPSMYNDPQFGTSCEITGFGKENSTDKLYPEQLKKTVVKLISHRECQQPHYYGSEVTTKMLCAADPQWKTDSCQGDSGGPLVCSLQGRMTLTGIVSWGKGCALKDKPGVYTRVSHFLPWIRSHTKEENGLAL

SEQ ID NO: 571 - protein, 253 aa, synthetic construct
  REGION 1..253: note = UROKINASE-TYPE PLASMINOGEN ACTIVATOR (u-PA) protease domain F30Y/R35S/H37G/V38D/Y40H/V41R/D60aP/Y60bE/L97bA/H9 9Q/C122S/Y149K/M157K
IIGGEFTTIENQPWYAAIYSRGRGGSDTHRCGGSLISPCWVISATHCFIPEPKKEDYIVYLGRSRLNSNTQGEMKFEVENLILHKDYSADTAAQHNDIALLKIRSKEGRCAQPSRTIQTISLPSMYNDPQFGTSCEITGFGKENSTDKLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 572 - protein, 253 aa, synthetic construct
  REGION 1..253: note = UROKINASE-TYPE PLASMINOGEN ACTIVATOR (u-PA) protease domain F30Y/R35Q/V38D/Y40H/V41R/D60aE/Y60bE/L97bA/H99Q/C1 22S/Y149N/M157K
IIGGEFTTIENQPWYAAIYQRHRGGSDTHRCGGSLISPCWVISATHCFIEEPKKEDYIVYLGRSRLNSNTQGEMKFEVENLILHKDYSADTAAQHNDIALLKIRSKEGRCAQPSRTIQTISLPSMYNDPQFGTSCEITGFGKENSTDNLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 573 - protein, 253 aa, synthetic construct
  REGION 1..253: note = UROKINASE-TYPE PLASMINOGEN ACTIVATOR (u-PA) protease domain F30Y/R35T/H37A/V38D/Y40H/V41R/D60aP/Y60bE/L97bA/H9 9Q/C122S/Y149K/M157K/R217Y
IIGGEFTTIENQPWYAAIYTRARGGSDTHRCGGSLISPCWVISATHCFIPEPKKEDYIVYLGRSRLNSNTQGEMKFEVENLILHKDYSADTAAQHNDIALLKIRSKEGRCAQPSRTIQTISLPSMYNDPQFGTSCEITGFGKENSTDKLYPEQLKKTVVKLISHRECQQPHYYGSEVTTKMLCAADPQWKTDSCQGDSGGPLVCSLQGRMTLTGIVSWGYGCALKDKPGVYTRVSHFLPWIRSHTKEENGLAL

SEQ ID NO: 574 - protein, 253 aa, synthetic construct
  REGION 1..253: note = UROKINASE-TYPE PLASMINOGEN ACTIVATOR (u-PA) protease domain F30Y/R35Q/V38D/Y40H/V41R/Y60bS/L97bA/H99Q/C122S/Y1 49R/M157K/R217E
IIGGEFTTIENQPWYAAIYQRHRGGSDTHRCGGSLISPCWVISATHCFIDSPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGEGCALKDKPGVYTRVSHFLPWIRSHTKEENGLAL

SEQ ID NO: 575 - protein, 253 aa, synthetic construct
  REGION 1..253: note = UROKINASE-TYPE PLASMINOGEN ACTIVATOR (u-PA) protease domain F30Y/R37aD/V38D/Y40L/V41R/L97bA/H99Q/C122S/M126K/M 157K
IIGGEFTTIENQPWYAAIYRRHDGGSDTLRCGGSLISPCWVISATHCFIDYPKKEDYIVYLGRSRLNSNTQGEMKFEVENLILHKDYSADTAAQHNDIALLKIRSKEGRCAQPSRTIQTISLPSKYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 576 - protein, 253 aa, synthetic construct
  REGION 1..253: note = UROKINASE-TYPE PLASMINOGEN ACTIVATOR (u-PA) protease domain F30Y/R35T/H37T/V38D/Y40H/V41R/D60aP/Y60bD/L97bA/H9 9Q/C122S/Y149T/M157K
IIGGEFTTIENQPWYAAIYTRTRGGSDTHRCGGSLISPCWVISATHCFIPDPKKEDYIVYLGRSRLNSNTQGEMKFEVENLILHKDYSADTAAQHNDIALLKIRSKEGRCAQPSRTIQTISLPSMYNDPQFGTSCEITGFGKENSTDTLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 577 - protein, 253 aa, synthetic construct
  REGION 1..253: note = UROKINASE-TYPE PLASMINOGEN ACTIVATOR (u-PA) protease domain F30Y/R35H/H37D/V38D/Y40H/V41R/D60aK/Y60bS/L97bA/H9 9Q/C122S/Y149R/M157K
IIGGEFTTIENQPWYAAIYHRDRGGSDTHRCGGSLISPCWVISATHCFIKSPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 578 - protein, 253 aa, synthetic construct
  REGION 1..253: note = UROKINASE-TYPE PLASMINOGEN ACTIVATOR (u-PA) protease domain F30Y/R35S/V38D/Y40H/V41R/D60aE/Y60bS/L97bA/H99Q/C1 22S/Y149R/M157K
IIGGEFTTIENQPWYAAIYSRHRGGSDTHRCGGSLISPCWVISATHCFIESPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 579 - protein, 253 aa, synthetic construct
  REGION 1..253: note = UROKINASE-TYPE PLASMINOGEN ACTIVATOR (u-PA) protease domain F30Y/R35H/H37T/V38D/Y40H/V41R/D60aR/Y60bD/L97bA/H9 9Q/C122S/Y149R/M157K
IIGGEFTTIENQPWYAAIYHRTRGGSDTHRCGGSLISPCWVISATHCFIRDPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 580 - protein, 253 aa, synthetic construct
  REGION 1..253: note = UROKINASE-TYPE PLASMINOGEN ACTIVATOR (u-PA) protease domain F30Y/R35Q/V38D/Y40H/V41R/D60aE/Y60bK/L97bA/H99Q/C1 22S/Y149R/M157K/R217I
IIGGEFTTIENQPWYAAIYQRHRGGSDTHRCGGSLISPCWVISATHCFIEKPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGIGCALKDKPGVYTRVSHFLPWIRSHTKEENGLAL

SEQ ID NO: 581 - protein, 253 aa, synthetic construct
  REGION 1..253: note = UROKINASE-TYPE PLASMINOGEN ACTIVATOR (u-PA) protease domain F30Y/R35Q/V38D/Y40H/V41R/D60aP/Y60bE/L97bA/H99Q/C1 22S/Y149R/M157K/R217K
IIGGEFTTIENQPWYAAIYQRHRGGSDTHRCGGSLISPCWVISATHCFIPEPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGKGCALKDKPGVYTRVSHFLPWIRSHTKEENGLAL

SEQ ID NO: 582 - protein, 253 aa, synthetic construct
  REGION 1..253: note = UROKINASE-TYPE PLASMINOGEN ACTIVATOR (u-PA) protease domain F30Y/R35Q/V38D/Y40H/V41R/D60aE/Y60bN/L97bA/H99Q/C1 22S/Y149R/M157K
IIGGEFTTIENQPWYAAIYQRHRGGSDTHRCGGSLISPCWVISATHCFIENPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 583 - protein, 253 aa, synthetic construct
  REGION 1..253: note = UROKINASE-TYPE PLASMINOGEN ACTIVATOR (u-PA) protease domain F30Y/R35T/H37T/V38D/Y40H/V41R/D60aT/Y60bS/L97bA/H9 9Q/C122S/Y149K/M157K
IIGGEFTTIENQPWYAAIYTRTRGGSDTHRCGGSLISPCWVISATHCFITSPKKEDYIVYLGRSRLNSNTQGEMKFEVENLILHKDYSADTAAQHNDIALLKIRSKEGRCAQPSRTIQTISLPSMYNDPQFGTSCEITGFGKENSTDKLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 584 - protein, 253 aa, synthetic construct
  REGION 1..253: note = UROKINASE-TYPE PLASMINOGEN ACTIVATOR (u-PA) protease domain F30Y/R36H/V38E/Y40H/V41R/T97aI/L97bA/H99Q/C122S/Y1 49N/L150V/M157K
IIGGEFTTIENQPWYAAIYRHHRGGSETHRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDNVYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 585 - protein, 253 aa, synthetic construct
  REGION 1..253: note = UROKINASE-TYPE PLASMINOGEN ACTIVATOR (u-PA) protease domain F30Y/R36H/V38E/Y40H/V41R/Y60bN/N87D/A96T/T97aI/L97 bA/H99Q/C122S/N145S/M157K/M207K
IIGGEFTTIENQPWYAAIYRHHRGGSETHRCGGSLISPCWVISATHCFIDNPKKEDYIVYLGRSRLNSNTQGEMKFEVEDLILHKDYSTDIAAQHNDIALLKIRSKEGRCAQPSRTIQTISLPSMYNDPQFGTSCEITGFGKESSTDYLYPEQLKKTVVKLISHRECQQPHYYGSEVTTKMLCAADPQWKTDSCQGDSGGPLVCSLQGRKTLTGIVSWGRGCALKDKPGVYTRVSHFLPWIRSHTKEENGLAL

SEQ ID NO: 586 - protein, 253 aa, synthetic construct
  REGION 1..253: note = UROKINASE-TYPE PLASMINOGEN ACTIVATOR (u-PA) protease domain F30Y/R36H/V38E/Y40H/V41R/T97aI/L97bA/H99Q/C122S/S1 46F/M157K/Q192H/K243Q
IIGGEFTTIENQPWYAAIYRHHRGGSETHRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENFTDYLYPEQLKKTVVKLISHRECQQPHYYGSEVTTKMLCAADPQWKTDSCHGDSGGPLVCSLQGRMTLTGIVSWGRGCALKDKPGVYTRVSHFLPWIRSHTQEENGLAL

SEQ ID NO: 587 - protein, 253 aa, synthetic construct
  REGION 1..253: note = UROKINASE-TYPE PLASMINOGEN ACTIVATOR (u-PA) protease domain F30Y/R36H/V38E/Y40H/V41R/K61E/T97aI/L97bA/H99Q/C12 2S/Y149H/M157K/K187R
IIGGEFTTIENQPWYAAIYRHHRGGSETHRCGGSLISPCWVISATHCFIDYPEKEDYIVYLGRSRLNSNTQGEMKFEVENLILHKDYSADIAAQHNDIALLKIRSKEGRCAQPSRTIQTISLPSMYNDPQFGTSCEITGFGKENSTDHLYPEQLKKTVVKLISHRECQQPHYYGSEVTTKMLCAADPQWRTDSCQGDSGGPLVCSLQGRMTLTGIVSWGRGCALKDKPGVYTRVSHFLPWIRSHTKEENGLAL

SEQ ID NO: 588 - protein, 253 aa, synthetic construct
  REGION 1..253: note = UROKINASE-TYPE PLASMINOGEN ACTIVATOR (u-PA) protease domain F30Y/R37aP/V38D/Y40H/V41R/Y60bN/E84D/L97bA/H99Q/C1 22S/M157K/T242I
IIGGEFTTIENQPWYAAIYRRHPGGSDTHRCGGSLISPCWVISATHCFIDNPKKEDYIVYLGRSRLNSNTQGEMKFDVENLILHKDYSADTAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHIKEENGLAL

SEQ ID NO: 589 - protein, 253 aa, synthetic construct
  REGION 1..253: note = UROKINASE-TYPE PLASMINOGEN ACTIVATOR (u-PA) protease domain F30Y/R37aP/G37bD/V38D/Y40H/V41R/Y60bN/L97bA/H99Q/C 122S/M157K
IIGGEFTTIENQPWYAAIYRRHPDGSDTHRCGGSLISPCWVISATHCFIDNPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 590 - protein, 253 aa, synthetic construct
  REGION 1..253: note = UROKINASE-TYPE PLASMINOGEN ACTIVATOR (u-PA) protease domain F30Y/R35L/R36H/H37P/V38E/Y40H/V41R/Y60bG/T97aD/L97 bA/H99Q/C122S/Y149R/M157K
IIGGEFTTIENQPWYAAIYLHPRGGSETHRCGGSLISPCWVISATHCFIDGPKKEDYIVYLGRSRLNSNTQGEMKFEVENLILHKDYSADDAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 591 - protein, 253 aa, synthetic construct
  REGION 1..253: note = UROKINASE-TYPE PLASMINOGEN ACTIVATOR (u-PA) protease domain F30Y/R36H/H37S/V38E/T39L/Y40H/V41R/Y60bH/T97aI/L97 bA/H99Q/C122S/Y149R/M157K
IIGGEFTTIENQPWYAAIYRHSRGGSELHRCGGSLISPCWVISATHCFIDHPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 592 - protein, 253 aa, synthetic construct
  REGION 1..253: note = UROKINASE-TYPE PLASMINOGEN ACTIVATOR (u-PA) protease domain F30Y/R35L/R36H/H37D/V38E/T39W/Y40H/V41R/Y60bA/T97a D/L97bA/H99Q/C122S/Y149R/M157K
IIGGEFTTIENQPWYAAIYLHDRGGSEWHRCGGSLISPCWVISATHCFIDAPKKEDYIVYLGRSRLNSNTQGEMKFEVENLILHKDYSADDAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 593 - protein, 253 aa, synthetic construct
  REGION 1..253: note = UROKINASE-TYPE PLASMINOGEN ACTIVATOR (u-PA) protease domain F30Y/R36H/H37P/V38E/T39Y/Y40H/V41R/Y60bN/L97bA/H99 Q/C122S/Y149R/M157K
IIGGEFTTIENQPWYAAIYRHPRGGSEYHRCGGSLISPCWVISATHCFIDNPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 594 - protein, 253 aa, synthetic construct
  REGION 1..253: note = UROKINASE-TYPE PLASMINOGEN ACTIVATOR (u-PA) protease domain F30Y/R36H/H37E/V38E/T39Y/Y40H/V41R/Y60bN/T97aV/L97 bA/H99Q/C122S/Y149K/M157K
IIGGEFTTIENQPWYAAIYRHERGGSEYHRCGGSLISPCWVISATHCFIDNPKKEDYIVYLGRSRLNSNTQGEMKFEVENLILHKDYSADVAAQHNDIALLKIRSKEGRCAQPSRTIQTISLPSMYNDPQFGTSCEITGFGKENSTDKLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 595 - protein, 253 aa, synthetic construct
  REGION 1..253: note = UROKINASE-TYPE PLASMINOGEN ACTIVATOR (u-PA) protease domain F30Y/R36H/H37G/V38E/T39W/Y40H/V41R/Y60bA/T97aE/L97 bA/H99Q/C122S/Y149Q/M157K
IIGGEFTTIENQPWYAAIYRHGRGGSEWHRCGGSLISPCWVISATHCFIDAPKKEDYIVYLGRSRLNSNTQGEMKFEVENLILHKDYSADEAAQHNDIALLKIRSKEGRCAQPSRTIQTISLPSMYNDPQFGTSCEITGFGKENSTDQLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 596 - protein, 253 aa, synthetic construct
  REGION 1..253: note = UROKINASE-TYPE PLASMINOGEN ACTIVATOR (u-PA) protease domain F30Y/R36H/H37E/V38E/T39W/Y40H/V41R/Y60bD/T97aD/L97 bA/H99Q/C122S/Y149R/M157K
IIGGEFTTIENQPWYAAIYRHERGGSEWHRCGGSLISPCWVISATHCFIDDPKKEDYIVYLGRSRLNSNTQGEMKFEVENLILHKDYSADDAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 597 - protein, 253 aa, synthetic construct
  REGION 1..253: note = UROKINASE-TYPE PLASMINOGEN ACTIVATOR (u-PA) protease domain F30Y/R36H/H37F/V38E/T39Y/Y40H/V41R/Y60bD/T97aV/L97 bA/H99Q/C122S/Y149L/M157K
IIGGEFTTIENQPWYAAIYRHFRGGSEYHRCGGSLISPCWVISATHCFIDDPKKEDYIVYLGRSRLNSNTQGEMKFEVENLILHKDYSADVAAQHNDIALLKIRSKEGRCAQPSRTIQTISLPSMYNDPQFGTSCEITGFGKENSTDLLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 598 - protein, 253 aa, synthetic construct
  REGION 1..253: note = UROKINASE-TYPE PLASMINOGEN ACTIVATOR (u-PA) protease domain F30Y/R36H/H37N/V38E/T39Y/Y40H/V41R/Y60bQ/T97aV/L97 bA/H99Q/C122S/Y149L/M157K
IIGGEFTTIENQPWYAAIYRHNRGGSEYHRCGGSLISPCWVISATHCFIDQPKKEDYIVYLGRSRLNSNTQGEMKFEVENLILHKDYSADVAAQHNDIALLKIRSKEGRCAQPSRTIQTISLPSMYNDPQFGTSCEITGFGKENSTDLLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 599 - protein, 253 aa, synthetic construct
  REGION 1..253: note = UROKINASE-TYPE PLASMINOGEN ACTIVATOR (u-PA) protease domain F30Y/R35L/R36H/H37E/V38E/T39L/Y40H/V41R/Y60bS/T97a D/L97bA/H99Q/C122S/Y149R/M157K
IIGGEFTTIENQPWYAAIYLHERGGSELHRCGGSLISPCWVISATHCFIDSPKKEDYIVYLGRSRLNSNTQGEMKFEVENLILHKDYSADDAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 600 - protein, 253 aa, synthetic construct
  REGION 1..253: note = UROKINASE-TYPE PLASMINOGEN ACTIVATOR (u-PA) protease domain F30Y/R36H/H37D/V38E/T39W/Y40H/V41R/Y60bV/T97aE/L97 bA/H99Q/C122S/Y149R/M157K
IIGGEFTTIENQPWYAAIYRHDRGGSEWHRCGGSLISPCWVISATHCFIDVPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 601 - protein, 253 aa, synthetic construct
  REGION 1..253: note = UROKINASE-TYPE PLASMINOGEN ACTIVATOR (u-PA) protease domain F30Y/R36H/H37A/V38E/T39Y/Y40H/V41R/Y60bQ/T97aV/L97 bA/H99Q/C122S/Y149R/M157K
IIGGEFTTIENQPWYAAIYRHARGGSEYHRCGGSLISPCWVISATHCFIDQPKKEDYIVYLGRSRLNSNTQGEMKFEVENLILHKDYSADVAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 602 - protein, 253 aa, synthetic construct
  REGION 1..253: note = UROKINASE-TYPE PLASMINOGEN ACTIVATOR (u-PA) protease domain F30Y/R36H/H37D/V38E/T39Y/Y40H/V41R/Y60bM/T97aD/L97 bA/H99Q/C122S/Y149R/M157K
IIGGEFTTIENQPWYAAIYRHDRGGSEYHRCGGSLISPCWVISATHCFIDMPKKEDYIVYLGRSRLNSNTQGEMKFEVENLILHKDYSADDAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 603 - protein, 253 aa, synthetic construct
  REGION 1..253: note = UROKINASE-TYPE PLASMINOGEN ACTIVATOR (u-PA) protease domain F30Y/R36H/H37D/V38E/T39W/Y40H/V41R/Y60bN/T97aV/L97 bA/H99Q/C122S/Y149R/M157K
IIGGEFTTIENQPWYAAIYRHDRGGSEWHRCGGSLISPCWVISATHCFIDNPKKEDYIVYLGRSRLNSNTQGEMKFEVENLILHKDYSADVAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 604 - protein, 253 aa, synthetic construct
  REGION 1..253: note = UROKINASE-TYPE PLASMINOGEN ACTIVATOR (u-PA) protease domain F30Y/R35W/R36H/H37D/V38E/T39Y/Y40H/V41R/Y60bS/T97a L/L97bA/H99Q/C122S/Y149L/M157K
IIGGEFTTIENQPWYAAIYWHDRGGSEYHRCGGSLISPCWVISATHCFIDSPKKEDYIVYLGRSRLNSNTQGEMKFEVENLILHKDYSADLAAQHNDIALLKIRSKEGRCAQPSRTIQTISLPSMYNDPQFGTSCEITGFGKENSTDLLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 605 - protein, 253 aa, synthetic construct
  REGION 1..253: note = UROKINASE-TYPE PLASMINOGEN ACTIVATOR (u-PA) protease domain F30Y/R36H/V38E/T39V/Y40H/V41R/Y60bH/T97aE/L97bA/H9 9Q/C122S/Y149S/M157K
IIGGEFTTIENQPWYAAIYRHHRGGSEVHRCGGSLISPCWVISATHCFIDHPKKEDYIVYLGRSRLNSNTQGEMKFEVENLILHKDYSADEAAQHNDIALLKIRSKEGRCAQPSRTIQTISLPSMYNDPQFGTSCEITGFGKENSTDSLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 606 - protein, 253 aa, synthetic construct
  REGION 1..253: note = UROKINASE-TYPE PLASMINOGEN ACTIVATOR (u-PA) protease domain F30Y/R36H/H37E/V38E/T39F/Y40H/V41R/Y60bN/T97aV/L97 bA/H99Q/C122S/Y149R/M157K
IIGGEFTTIENQPWYAAIYRHERGGSEFHRCGGSLISPCWVISATHCFIDNPKKEDYIVYLGRSRLNSNTQGEMKFEVENLILHKDYSADVAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 607 - protein, 253 aa, synthetic construct
  REGION 1..253: note = UROKINASE-TYPE PLASMINOGEN ACTIVATOR (u-PA) protease domain F30Y/R36H/H37G/V38E/T39Y/Y40H/V41R/Y60bN/T97aA/L97 bA/H99Q/C122S/Y149R/M157K
IIGGEFTTIENQPWYAAIYRHGRGGSEYHRCGGSLISPCWVISATHCFIDNPKKEDYIVYLGRSRLNSNTQGEMKFEVENLILHKDYSADAAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 608 - protein, 253 aa, synthetic construct
  REGION 1..253: note = UROKINASE-TYPE PLASMINOGEN ACTIVATOR (u-PA) protease domain F30Y/R35I/R36H/H37E/V38E/T39Y/Y40H/V41R/Y60bS/T97a V/L97bA/H99Q/C122S/Y149L/M157K
IIGGEFTTIENQPWYAAIYIHERGGSEYHRCGGSLISPCWVISATHCFIDSPKKEDYIVYLGRSRLNSNTQGEMKFEVENLILHKDYSADVAAQHNDIALLKIRSKEGRCAQPSRTIQTISLPSMYNDPQFGTSCEITGFGKENSTDLLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 609 - protein, 253 aa, synthetic construct
  REGION 1..253: note = UROKINASE-TYPE PLASMINOGEN ACTIVATOR (u-PA) protease domain F30Y/R35L/H37D/V38D/Y40H/V41R/D60aE/Y60bT/L97bA/H9 9Q/C122S/Y149R/M157K
IIGGEFTTIENQPWYAAIYLRDRGGSDTHRCGGSLISPCWVISATHCFIETPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 610 - protein, 253 aa, synthetic construct
  REGION 1..253: note = UROKINASE-TYPE PLASMINOGEN ACTIVATOR (u-PA) protease domain F30Y/R35Q/V38D/Y40H/V41R/D60aK/Y60bV/L97bA/H99Q/C1 22S/Y149R/M157K
IIGGEFTTIENQPWYAAIYQRHRGGSDTHRCGGSLISPCWVISATHCFIKVPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 611 - protein, 253 aa, synthetic construct
  REGION 1..253: note = UROKINASE-TYPE PLASMINOGEN ACTIVATOR (u-PA) protease domain F30Y/R35W/R36H/H37S/V38E/T39Y/Y40H/V41R/Y60bN/T97a E/L97bA/H99Q/C122S/Y149R/M157K
IIGGEFTTIENQPWYAAIYWHSRGGSEYHRCGGSLISPCWVISATHCFIDNPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 612 - protein, 253 aa, synthetic construct
  REGION 1..253: note = UROKINASE-TYPE PLASMINOGEN ACTIVATOR (u-PA) protease domain F30Y/R35W/R36H/H37Q/V38E/T39H/Y40H/V41R/T97aE/L97b A/H99Q/C122S/Y149L/M157K
IIGGEFTTIENQPWYAAIYWHQRGGSEHHRCGGSLISPCWVISATHCFIDYPKKEDYIVYLGRSRLNSNTQGEMKFEVENLILHKDYSADEAAQHNDIALLKIRSKEGRCAQPSRTIQTISLPSMYNDPQFGTSCEITGFGKENSTDLLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 613 - protein, 253 aa, synthetic construct
  REGION 1..253: note = UROKINASE-TYPE PLASMINOGEN ACTIVATOR (u-PA) protease domain F30Y/R35W/R36H/H37D/V38E/T39Y/Y40H/V41R/Y60bD/T97a I/L97bA/H99Q/C122S/M157K
IIGGEFTTIENQPWYAAIYWHDRGGSEYHRCGGSLISPCWVISATHCFIDDPKKEDYIVYLGRSRLNSNTQGEMKFEVENLILHKDYSADIAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 614 - protein, 253 aa, synthetic construct
  REGION 1..253: note = UROKINASE-TYPE PLASMINOGEN ACTIVATOR (u-PA) protease domain F30Y/R35V/R36H/H37G/V38E/T39W/Y40H/V41R/Y60bW/T97a I/L97bA/H99Q/C122S/Y149E/M157K
IIGGEFTTIENQPWYAAIYVHGRGGSEWHRCGGSLISPCWVISATHCFIDWPKKEDYIVYLGRSRLNSNTQGEMKFEVENLILHKDYSADIAAQHNDIALLKIRSKEGRCAQPSRTIQTISLPSMYNDPQFGTSCEITGFGKENSTDELYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 615 - protein, 253 aa, synthetic construct
  REGION 1..253: note = UROKINASE-TYPE PLASMINOGEN ACTIVATOR (u-PA) protease domain F30Y/R35M/R36H/H37G/V38E/T39F/Y40H/V41R/Y60bP/T97a F/L97bA/H99Q/C122S/Y149R/M157K
IIGGEFTTIENQPWYAAIYMHGRGGSEFHRCGGSLISPCWVISATHCFIDPPKKEDYIVYLGRSRLNSNTQGEMKFEVENLILHKDYSADFAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 616 - protein, 253 aa, synthetic construct
  REGION 1..253: note = UROKINASE-TYPE PLASMINOGEN ACTIVATOR (u-PA) protease domain F30Y/R35V/R36H/H37G/V38E/T39W/Y40H/V41R/Y60bA/T97a I/L97bA/H99Q/C122S/Y149R/M157K
IIGGEFTTIENQPWYAAIYVHGRGGSEWHRCGGSLISPCWVISATHCFIDAPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 617 - protein, 253 aa, synthetic construct
  REGION 1..253: note = UROKINASE-TYPE PLASMINOGEN ACTIVATOR (u-PA) protease domain F30Y/R35V/R36H/H37S/V38E/T39F/Y40H/V41R/Y60bS/T97a M/L97bA/H99Q/C122S/Y149W/M157K
IIGGEFTTIENQPWYAAIYVHSRGGSEFHRCGGSLISPCWVISATHCFIDSPKKEDYIVYLGRSRLNSNTQGEMKFEVENLILHKDYSADMAAQHNDIALLKIRSKEGRCAQPSRTIQTISLPSMYNDPQFGTSCEITGFGKENSTDWLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 618 - protein, 253 aa, synthetic construct
  REGION 1..253: note = UROKINASE-TYPE PLASMINOGEN ACTIVATOR (u-PA) protease domain F30Y/R35W/R36H/H37D/V38E/T39Y/Y40H/V41R/Y60bT/T97a D/L97bA/H99Q/C122S/Y149R/M157K
IIGGEFTTIENQPWYAAIYWHDRGGSEYHRCGGSLISPCWVISATHCFIDTPKKEDYIVYLGRSRLNSNTQGEMKFEVENLILHKDYSADDAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 619 - protein, 253 aa, synthetic construct
  REGION 1..253: note = UROKINASE-TYPE PLASMINOGEN ACTIVATOR (u-PA) protease domain F30Y/R35L/R36H/H37G/V38E/T39Y/Y40H/V41R/Y60bP/T97a E/L97bA/H99Q/C122S/Y149M/M157K
IIGGEFTTIENQPWYAAIYLHGRGGSEYHRCGGSLISPCWVISATHCFIDPPKKEDYIVYLGRSRLNSNTQGEMKFEVENLILHKDYSADEAAQHNDIALLKIRSKEGRCAQPSRTIQTISLPSMYNDPQFGTSCEITGFGKENSTDMLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 620 - protein, 253 aa, synthetic construct
  REGION 1..253: note = UROKINASE-TYPE PLASMINOGEN ACTIVATOR (u-PA) protease domain F30Y/R35F/R36H/H37G/V38E/T39Y/Y40H/V41R/Y60bS/T97a D/L97bA/H99Q/C122S/Y149R/M157K
IIGGEFTTIENQPWYAAIYFHGRGGSEYHRCGGSLISPCWVISATHCFIDSPKKEDYIVYLGRSRLNSNTQGEMKFEVENLILHKDYSADDAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 621 - protein, 253 aa, synthetic construct
  REGION 1..253: note = UROKINASE-TYPE PLASMINOGEN ACTIVATOR (u-PA) protease domain F30Y/R35V/R36H/H37S/V38E/T39Y/Y40H/V41R/Y60bP/T97a E/L97bA/H99Q/C122S/Y149E/M157K
IIGGEFTTIENQPWYAAIYVHSRGGSEYHRCGGSLISPCWVISATHCFIDPPKKEDYIVYLGRSRLNSNTQGEMKFEVENLILHKDYSADEAAQHNDIALLKIRSKEGRCAQPSRTIQTISLPSMYNDPQFGTSCEITGFGKENSTDELYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 622 - protein, 253 aa, synthetic construct
  REGION 1..253: note = UROKINASE-TYPE PLASMINOGEN ACTIVATOR (u-PA) protease domain F30Y/R35V/R36H/H37S/V38E/T39F/Y40H/V41R/Y60bS/T97a I/L97bA/H99Q/C122S/Y149R/M157K/Q192T
IIGGEFTTIENQPWYAAIYVHSRGGSEFHRCGGSLISPCWVISATHCFIDSPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCTGDSGGPLVCSLQGRMTLTGIVSWGRGCALKDKPGVYTRVSHFLPWIRSHTKEENGLAL

SEQ ID NO: 623 - protein, 253 aa, synthetic construct
  REGION 1..253: note = UROKINASE-TYPE PLASMINOGEN ACTIVATOR (u-PA) protease domain F30Y/R35V/R36H/H37K/V38E/T39F/Y40H/V41R/Y60bN/T97a I/L97bA/H99Q/C122S/Y149R/M157K
IIGGEFTTIENQPWYAAIYVHKRGGSEFHRCGGSLISPCWVISATHCFIDNPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 624 - protein, 253 aa, synthetic construct
  REGION 1..253: note = UROKINASE-TYPE PLASMINOGEN ACTIVATOR (u-PA) protease domain F30Y/R35V/R36H/H37D/V38E/T39W/Y40H/V41R/Y60bP/T97a I/L97bA/H99Q/C122S/Y149R/M157K
IIGGEFTTIENQPWYAAIYVHDRGGSEWHRCGGSLISPCWVISATHCFIDPPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 625 - protein, 253 aa, synthetic construct
  REGION 1..253: note = UROKINASE-TYPE PLASMINOGEN ACTIVATOR (u-PA) protease domain F30Y/R35V/R36H/H37G/V38E/T39L/Y40H/V41R/Y60bT/T97a I/L97bA/H99Q/C122S/Y149R/M157K/Q192T/R239H
IIGGEFTTIENQPWYAAIYVHGRGGSELHRCGGSLISPCWVISATHCFIDTPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCTGDSGGPLVCSLQGRMTLTGIVSWGRGCALKDKPGVYTRVSHFLPWIHSHTKEENGLAL

SEQ ID NO: 626 - protein, 253 aa, synthetic construct
  REGION 1..253: note = UROKINASE-TYPE PLASMINOGEN ACTIVATOR (u-PA) protease domain F30Y/R35Y/R36H/H37E/V38E/T39L/Y40H/V41W/Y60bE/T97a I/L97bA/H99Q/C122S/Y149R/M157K/Q192F
IIGGEFTTIENQPWYAAIYYHERGGSELHWCGGSLISPCWVISATHCFIDEPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCFGDSGGPLVCSLQGRMTLTGIVSWGRGCALKDKPGVYTRVSHFLPWIRSHTKEENGLAL

SEQ ID NO: 627 - protein, 253 aa, synthetic construct
  REGION 1..253: note = UROKINASE-TYPE PLASMINOGEN ACTIVATOR (u-PA) protease domain F30Y/R35W/R36H/H37D/V38E/T39F/Y40H/V41R/Y60bE/T97a I/L97bA/H99Q/C122S/Y149R/M157K
IIGGEFTTIENQPWYAAIYWHDRGGSEFHRCGGSLISPCWVISATHCFIDEPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 628 - protein, 253 aa, synthetic construct
  REGION 1..253: note = UROKINASE-TYPE PLASMINOGEN ACTIVATOR (u-PA) protease domain F30Y/R35W/R36H/H37D/V38E/T39Y/Y40H/V41R/Y60bA/T97a I/L97bA/H99Q/C122S/Y149R/M157K
IIGGEFTTIENQPWYAAIYWHDRGGSEYHRCGGSLISPCWVISATHCFIDAPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 629 - protein, 253 aa, synthetic construct
  REGION 1..253: note = UROKINASE-TYPE PLASMINOGEN ACTIVATOR (u-PA) protease domain F30Y/R35W/R36H/H37E/V38E/T39Y/Y40H/V41R/Y60bD/T97a I/L97bA/H99Q/C122S/Y149R/M157K/Q192M
IIGGEFTTIENQPWYAAIYWHERGGSEYHRCGGSLISPCWVISATHCFIDDPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCMGDSGGPLVCSLQGRMTLTGIVSWGRGCALKDKPGVYTRVSHFLPWIRSHTKEENGLAL

SEQ ID NO: 630 - protein, 253 aa, synthetic construct
  REGION 1..253: note = UROKINASE-TYPE PLASMINOGEN ACTIVATOR (u-PA) protease domain F30Y/R35W/R36H/H37E/V38E/T39V/Y40H/V41W/Y60bS/T97a I/L97bA/H99Q/C122S/Y149R/M157K/Q192H
IIGGEFTTIENQPWYAAIYWHERGGSEVHWCGGSLISPCWVISATHCFIDSPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCHGDSGGPLVCSLQGRMTLTGIVSWGRGCALKDKPGVYTRVSHFLPWIRSHTKEENGLAL

SEQ ID NO: 631 - protein, 253 aa, synthetic construct
  REGION 1..253: note = UROKINASE-TYPE PLASMINOGEN ACTIVATOR (u-PA) protease domain F30Y/R35Y/R36H/H37E/V38E/T39A/Y40H/V41W/Y60bV/T97a I/L97bA/H99Q/C122S/Y149R/M157K/Q192H
IIGGEFTTIENQPWYAAIYYHERGGSEAHWCGGSLISPCWVISATHCFIDVPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCHGDSGGPLVCSLQGRMTLTGIVSWGRGCALKDKPGVYTRVSHFLPWIRSHTKEENGLAL

SEQ ID NO: 632 - protein, 253 aa, synthetic construct
  REGION 1..253: note = UROKINASE-TYPE PLASMINOGEN ACTIVATOR (u-PA) protease domain F30Y/R35Y/R36H/H37P/V38E/T39R/Y40H/V41W/Y60bE/T97a I/L97bA/H99Q/C122S/M157K/Q192F
IIGGEFTTIENQPWYAAIYYHPRGGSERHWCGGSLISPCWVISATHCFIDEPKKEDYIVYLGRSRLNSNTQGEMKFEVENLILHKDYSADIAAQHNDIALLKIRSKEGRCAQPSRTIQTISLPSMYNDPQFGTSCEITGFGKENSTDYLYPEQLKKTVVKLISHRECQQPHYYGSEVTTKMLCAADPQWKTDSCFGDSGGPLVCSLQGRMTLTGIVSWGRGCALKDKPGVYTRVSHFLPWIRSHTKEENGLAL

SEQ ID NO: 633 - protein, 253 aa, synthetic construct
  REGION 1..253: note = UROKINASE-TYPE PLASMINOGEN ACTIVATOR (u-PA) protease domain F30Y/R35Y/R36H/H37D/V38E/T39W/Y40H/V41R/Y60bE/T97a I/L97bA/H99Q/C122S/Y149R/M157K
IIGGEFTTIENQPWYAAIYYHDRGGSEWHRCGGSLISPCWVISATHCFIDEPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 634 - protein, 253 aa, synthetic construct
  REGION 1..253: note = UROKINASE-TYPE PLASMINOGEN ACTIVATOR (u-PA) protease domain F30Y/R35W/R36H/H37E/V38E/T39V/Y40H/V41W/Y60bA/T97a I/L97bA/H99Q/C122S/Y149R/M157K/Q192A
IIGGEFTTIENQPWYAAIYWHERGGSEVHWCGGSLISPCWVISATHCFIDAPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCAGDSGGPLVCSLQGRMTLTGIVSWGRGCALKDKPGVYTRVSHFLPWIRSHTKEENGLAL

SEQ ID NO: 635 - protein, 253 aa, synthetic construct
  REGION 1..253: note = UROKINASE-TYPE PLASMINOGEN ACTIVATOR (u-PA) protease domain R35Q/H37D/V38D/T39H/V41R/Y60bP/L97bA/H99Q/C122S/Y1 49R/Q192T
IIGGEFTTIENQPWFAAIYQRDRGGSDHYRCGGSLISPCWVISATHCFIDPPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCTGDSGGPLVCSLQGRMTLTGIVSWGRGCALKDKPGVYTRVSHFLPWIRSHTKEENGLAL

SEQ ID NO: 636 - protein, 253 aa, synthetic construct
  REGION 1..253: note = UROKINASE-TYPE PLASMINOGEN ACTIVATOR (u-PA) protease domain R35F/H37G/V38D/T39H/V41A/Y60bD/L97bA/H99Q/C122S/Y1 49R
IIGGEFTTIENQPWFAAIYFRGRGGSDHYACGGSLISPCWVISATHCFIDDPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 637 - protein, 253 aa, synthetic construct
  REGION 1..253: note = UROKINASE-TYPE PLASMINOGEN ACTIVATOR (u-PA) protease domain R35E/H37D/V38D/T39N/V41R/Y60bN/L97bA/H99Q/C122S/Y1 49R
IIGGEFTTIENQPWFAAIYERDRGGSDNYRCGGSLISPCWVISATHCFIDNPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 638 - protein, 253 aa, synthetic construct
  REGION 1..253: note = UROKINASE-TYPE PLASMINOGEN ACTIVATOR (u-PA) protease domain R35Q/H37Y/V38D/T39A/V41R/Y60bP/L97bA/H99Q/C122S/Y1 49R/Q192S
IIGGEFTTIENQPWFAAIYQRYRGGSDAYRCGGSLISPCWVISATHCFIDPPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCSGDSGGPLVCSLQGRMTLTGIVSWGRGCALKDKPGVYTRVSHFLPWIRSHTKEENGLAL

SEQ ID NO: 639 - protein, 253 aa, synthetic construct
  REGION 1..253: note = UROKINASE-TYPE PLASMINOGEN ACTIVATOR (u-PA) protease domain R35Q/H37Y/V38D/T39F/V41R/Y60bP/L97bA/H99Q/C122S/Y1 49R/Q192G
IIGGEFTTIENQPWFAAIYQRYRGGSDFYRCGGSLISPCWVISATHCFIDPPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCGGDSGGPLVCSLQGRMTLTGIVSWGRGCALKDKPGVYTRVSHFLPWIRSHTKEENGLAL

SEQ ID NO: 640 - protein, 253 aa, synthetic construct
  REGION 1..253: note = UROKINASE-TYPE PLASMINOGEN ACTIVATOR (u-PA) protease domain R35F/H37E/V38D/T39S/V41A/Y60bD/L97bA/H99Q/C122S
IIGGEFTTIENQPWFAAIYFRERGGSDSYACGGSLISPCWVISATHCFIDDPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 641 - protein, 253 aa, synthetic construct
  REGION 1..253: note = UROKINASE-TYPE PLASMINOGEN ACTIVATOR (u-PA) protease domain R35D/H37R/V38D/T39V/V41T/Y60bT/L97bA/H99Q/C122S/Q1 92A
IIGGEFTTIENQPWFAAIYDRRRGGSDVYTCGGSLISPCWVISATHCFIDTPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCAGDSGGPLVCSLQGRMTLTGIVSWGRGCALKDKPGVYTRVSHFLPWIRSHTKEENGLAL

SEQ ID NO: 642 - protein, 253 aa, synthetic construct
  REGION 1..253: note = UROKINASE-TYPE PLASMINOGEN ACTIVATOR (u-PA) protease domain R35Q/H37G/V38D/T39W/V41R/Y60bP/L97bA/H99Q/C122S/Y1 49R/Q192G
IIGGEFTTIENQPWFAAIYQRGRGGSDWYRCGGSLISPCWVISATHCFIDPPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCGGDSGGPLVCSLQGRMTLTGIVSWGRGCALKDKPGVYTRVSHFLPWIRSHTKEENGLAL

SEQ ID NO: 643 - protein, 253 aa, synthetic construct
  REGION 1..253: note = UROKINASE-TYPE PLASMINOGEN ACTIVATOR (u-PA) protease domain R35Q/H37M/V38D/T39V/V41R/Y60bP/L97bA/H99Q/C122S/Y1 49R
IIGGEFTTIENQPWFAAIYQRMRGGSDVYRCGGSLISPCWVISATHCFIDPPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 644 - protein, 253 aa, synthetic construct
  REGION 1..253: note = UROKINASE-TYPE PLASMINOGEN ACTIVATOR (u-PA) protease domain R35L/H37E/V38D/T39Y/V41R/L97bA/H99Q/C122S/Y149R
IIGGEFTTIENQPWFAAIYLRERGGSDYYRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 645 - protein, 253 aa, synthetic construct
  REGION 1..253: note = UROKINASE-TYPE PLASMINOGEN ACTIVATOR (u-PA) protease domain R35W/H37D/V38D/T39Y/V41R/Y60bS/L97bA/H99Q/C122S/Y1 49R
IIGGEFTTIENQPWFAAIYWRDRGGSDYYRCGGSLISPCWVISATHCFIDSPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 646 - protein, 253 aa, synthetic construct
  REGION 1..253: note = UROKINASE-TYPE PLASMINOGEN ACTIVATOR (u-PA) protease domain R35G/H37G/V38D/T39W/V41A/Y60bN/L97bA/H99Q/C122S
IIGGEFTTIENQPWFAAIYGRGRGGSDWYACGGSLISPCWVISATHCFIDNPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 647 - protein, 253 aa, synthetic construct
  REGION 1..253: note = UROKINASE-TYPE PLASMINOGEN ACTIVATOR (u-PA) protease domain R35Q/H37N/V38D/T39Y/V41R/Y60bP/L97bA/H99Q/C122S
IIGGEFTTIENQPWFAAIYQRNRGGSDYYRCGGSLISPCWVISATHCFIDPPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 648 - protein, 253 aa, synthetic construct
  REGION 1..253: note = UROKINASE-TYPE PLASMINOGEN ACTIVATOR (u-PA) protease domain R35W/H37D/V38D/T39Y/V41R/Y60bH/L97bA/H99Q/C122S/Y1 49R
IIGGEFTTIENQPWFAAIYWRDRGGSDYYRCGGSLISPCWVISATHCFIDHPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 649 - protein, 253 aa, synthetic construct
  REGION 1..253: note = UROKINASE-TYPE PLASMINOGEN ACTIVATOR (u-PA) protease domain F30Y/R35Q/R36H/H37G/V38E/T39H/Y40F/V41R/T97aI/L97b A/H99Q/C122S/Y149R/M157K/Q192M
IIGGEFTTIENQPWYAAIYQHGRGGSEHFRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCMGDSGGPLVCSLQGRMTLTGIVSWGRGCALKDKPGVYTRVSHFLPWIRSHTKEENGLAL

SEQ ID NO: 650 - protein, 253 aa, synthetic construct
  REGION 1..253: note = UROKINASE-TYPE PLASMINOGEN ACTIVATOR (u-PA) protease domain R35V/R36H/H37D/V38E/T39W/Y40M/V41R/T97aI/L97bA/H99 Q/C122S/Y149R/M157K
IIGGEFTTIENQPWFAAIYVHDRGGSEWMRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 651 - protein, 253 aa, synthetic construct
  REGION 1..253: note = UROKINASE-TYPE PLASMINOGEN ACTIVATOR (u-PA) protease domain F30Y/R35L/R36H/H37D/V38E/T39Y/Y40F/V41R/T97aI/L97b A/H99Q/C122S/Y149R/M157K/Q192N
IIGGEFTTIENQPWYAAIYLHDRGGSEYFRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCNGDSGGPLVCSLQGRMTLTGIVSWGRGCALKDKPGVYTRVSHFLPWIRSHTKEENGLAL

SEQ ID NO: 652 - protein, 253 aa, synthetic construct
  REGION 1..253: note = UROKINASE-TYPE PLASMINOGEN ACTIVATOR (u-PA) protease domain F30Y/R35L/R36H/H37E/V38E/T39L/Y40F/V41R/T97aI/L97b A/H99Q/C122S/Y149R/M157K/Q192H
IIGGEFTTIENQPWYAAIYLHERGGSELFRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCHGDSGGPLVCSLQGRMTLTGIVSWGRGCALKDKPGVYTRVSHFLPWIRSHTKEENGLAL

SEQ ID NO: 653 - protein, 253 aa, synthetic construct
  REGION 1..253: note = UROKINASE-TYPE PLASMINOGEN ACTIVATOR (u-PA) protease domain F30H/R35Q/R36H/H37Y/V38E/T39Y/Y40L/V41R/T97aI/L97b A/H99Q/C122S/Y149R/M157K
IIGGEFTTIENQPWHAAIYQHYRGGSEYLRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 654 - protein, 253 aa, synthetic construct
  REGION 1..253: note = UROKINASE-TYPE PLASMINOGEN ACTIVATOR (u-PA) protease domain F30Y/R36H/V38E/Y40H/V41R/T97aI/L97bA/H99Q/C122S/Y1 49R/M157K/Q192Y
IIGGEFTTIENQPWYAAIYRHHRGGSETHRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCYGDSGGPLVCSLQGRMTLTGIVSWGRGCALKDKPGVYTRVSHFLPWIRSHTKEENGLAL

SEQ ID NO: 655 - protein, 253 aa, synthetic construct
  REGION 1..253: note = UROKINASE-TYPE PLASMINOGEN ACTIVATOR (u-PA) protease domain F30L/R35L/R36H/H37D/V38E/T39Y/V41K/T97aI/L97bA/H99 Q/C122S/Y149R/M157K
IIGGEFTTIENQPWLAAIYLHDRGGSEYYKCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 656 - protein, 253 aa, synthetic construct
  REGION 1..253: note = UROKINASE-TYPE PLASMINOGEN ACTIVATOR (u-PA) protease domain R35Q/R36H/H37Y/V38E/T39Y/Y40L/V41R/T97aI/L97bA/H99 Q/C122S/Y149R/M157K
IIGGEFTTIENQPWFAAIYQHYRGGSEYLRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 657 - protein, 253 aa, synthetic construct
  REGION 1..253: note = UROKINASE-TYPE PLASMINOGEN ACTIVATOR (u-PA) protease domain F30Y/R35L/R36H/H37E/V38E/T39N/Y40F/V41R/T97aI/L97b A/H99Q/C122S/Y149R/M157K
IIGGEFTTIENQPWYAAIYLHERGGSENFRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 658 - protein, 253 aa, synthetic construct
  REGION 1..253: note = UROKINASE-TYPE PLASMINOGEN ACTIVATOR (u-PA) protease domain F30Y/R35I/R36H/H37D/V38E/T39F/Y40F/V41R/T97aI/L97b A/H99Q/C122S/Y149R/M157K
IIGGEFTTIENQPWYAAIYIHDRGGSEFFRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 659 - protein, 253 aa, synthetic construct
  REGION 1..253: note = UROKINASE-TYPE PLASMINOGEN ACTIVATOR (u-PA) protease domain F30Y/R35W/R36H/H37E/V38E/T39S/Y40L/V41R/T97aI/L97b A/H99Q/C122S/Y149R/M157K/Q192A
IIGGEFTTIENQPWYAAIYWHERGGSESLRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCAGDSGGPLVCSLQGRMTLTGIVSWGRGCALKDKPGVYTRVSHFLPWIRSHTKEENGLAL

SEQ ID NO: 660 - protein, 253 aa, synthetic construct
  REGION 1..253: note = UROKINASE-TYPE PLASMINOGEN ACTIVATOR (u-PA) protease domain R35E/R36H/H37D/V38E/T39W/Y40F/V41R/T97aI/L97bA/H99 Q/C122S/Y149R/M157K/Q192T
IIGGEFTTIENQPWFAAIYEHDRGGSEWFRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCTGDSGGPLVCSLQGRMTLTGIVSWGRGCALKDKPGVYTRVSHFLPWIRSHTKEENGLAL

SEQ ID NO: 661 - protein, 253 aa, synthetic construct
  REGION 1..253: note = UROKINASE-TYPE PLASMINOGEN ACTIVATOR (u-PA) protease domain F30H/R35L/R36H/H37E/V38E/T39F/Y40F/V41R/T97aI/L97b A/H99Q/C122S/Y149R/M157K
IIGGEFTTIENQPWHAAIYLHERGGSEFFRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 662 - protein, 253 aa, synthetic construct
  REGION 1..253: note = UROKINASE-TYPE PLASMINOGEN ACTIVATOR (u-PA) protease domain F30H/R35L/R36H/H37D/V38E/T39Y/Y40F/V41Q/T97aI/L97b A/H99Q/C122S/Y149R/M157K
IIGGEFTTIENQPWHAAIYLHDRGGSEYFQCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 663 - protein, 253 aa, synthetic construct
  REGION 1..253: note = UROKINASE-TYPE PLASMINOGEN ACTIVATOR (u-PA) protease domain F30Y/R35W/R36H/H37D/V38E/T39Y/Y40F/V41R/Y60bS/T97a E/L97bA/H99Q/C122S/Y149K/M157K
IIGGEFTTIENQPWYAAIYWHDRGGSEYFRCGGSLISPCWVISATHCFIDSPKKEDYIVYLGRSRLNSNTQGEMKFEVENLILHKDYSADEAAQHNDIALLKIRSKEGRCAQPSRTIQTISLPSMYNDPQFGTSCEITGFGKENSTDKLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 664 - protein, 253 aa, synthetic construct
  REGION 1..253: note = UROKINASE-TYPE PLASMINOGEN ACTIVATOR (u-PA) protease domain F30Y/R35W/R36H/H37E/S37dP/V38E/T39W/Y40H/V41R/Y60b Q/T97aE/L97bA/H99Q/C122S/Y149K/M157K
IIGGEFTTIENQPWYAAIYWHERGGPEWHRCGGSLISPCWVISATHCFIDQPKKEDYIVYLGRSRLNSNTQGEMKFEVENLILHKDYSADEAAQHNDIALLKIRSKEGRCAQPSRTIQTISLPSMYNDPQFGTSCEITGFGKENSTDKLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 665 - protein, 253 aa, synthetic construct
  REGION 1..253: note = UROKINASE-TYPE PLASMINOGEN ACTIVATOR (u-PA) protease domain I24T/F30Y/R35W/R36H/H37E/V38E/T39W/Y40H/V41R/Y60bQ /T97aE/L97bA/H99Q/C122S/Y149K/M157K
IIGGEFTTTENQPWYAAIYWHERGGSEWHRCGGSLISPCWVISATHCFIDQPKKEDYIVYLGRSRLNSNTQGEMKFEVENLILHKDYSADEAAQHNDIALLKIRSKEGRCAQPSRTIQTISLPSMYNDPQFGTSCEITGFGKENSTDKLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 666 - protein, 253 aa, synthetic construct
  REGION 1..253: note = UROKINASE-TYPE PLASMINOGEN ACTIVATOR (u-PA) protease domain I24N/F30Y/R35W/R36H/H37E/V38E/T39W/Y40L/V41R/Y60bQ /N87D/T97aE/L97bA/H99Q/C122S/Y149K/M157K
IIGGEFTTNENQPWYAAIYWHERGGSEWLRCGGSLISPCWVISATHCFIDQPKKEDYIVYLGRSRLNSNTQGEMKFEVEDLILHKDYSADEAAQHNDIALLKIRSKEGRCAQPSRTIQTISLPSMYNDPQFGTSCEITGFGKENSTDKLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 667 - protein, 253 aa, synthetic construct
  REGION 1..253: note = UROKINASE-TYPE PLASMINOGEN ACTIVATOR (u-PA) protease domain F30Y/R35W/R36H/H37S/V38E/Y40H/Y60bN/T97aE/L97bA/H9 9Q/C122S/Y149R/M157K
IIGGEFTTIENQPWYAAIYWHSRGGSETHVCGGSLISPCWVISATHCFIDNPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 668 - protein, 253 aa, synthetic construct
  REGION 1..253: note = UROKINASE-TYPE PLASMINOGEN ACTIVATOR (u-PA) protease domain F30Y/R35W/H37Y/V38E/T39Y/Y40H/V41R/Y60bN/T97aE/L97 bA/H99Q/C122S/Y149R
IIGGEFTTIENQPWYAAIYWRYRGGSEYHRCGGSLISPCWVISATHCFIDNPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 669 - protein, 253 aa, synthetic construct
  REGION 1..253: note = UROKINASE-TYPE PLASMINOGEN ACTIVATOR (u-PA) protease domain F30Y/R35W/H37S/V38E/T39Y/Y40H/V41R/Y60bN/T97aI/L97 bA/H99Q/C122S/Y149R/M157K
IIGGEFTTIENQPWYAAIYWRSRGGSEYHRCGGSLISPCWVISATHCFIDNPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 670 - protein, 253 aa, synthetic construct
  REGION 1..253: note = UROKINASE-TYPE PLASMINOGEN ACTIVATOR (u-PA) protease domain F30Y/R35W/R36H/H37S/V38E/T39Y/Y40H/V41R/Y60bN/T97a E/L97bA/H99Q/C122S/Y149R
IIGGEFTTIENQPWYAAIYWHSRGGSEYHRCGGSLISPCWVISATHCFIDNPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 671 - protein, 253 aa, synthetic construct
  REGION 1..253: note = UROKINASE-TYPE PLASMINOGEN ACTIVATOR (u-PA) protease domain R35Y/R36H/H37S/V38D/T39Y/V41R/Y60bN/T97aI/L97bA/H9 9Q/C122S/Y149R
IIGGEFTTIENQPWFAAIYYHSRGGSDYYRCGGSLISPCWVISATHCFIDNPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 672 - protein, 253 aa, synthetic construct
  REGION 1..253: note = UROKINASE-TYPE PLASMINOGEN ACTIVATOR (u-PA) protease domain R36H/H37S/V38E/T39W/V41R/Y60bN/T97aI/L97bA/H99Q/C1 22S/Y149R
IIGGEFTTIENQPWFAAIYRHSRGGSEWYRCGGSLISPCWVISATHCFIDNPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 673 - protein, 253 aa, synthetic construct
  REGION 1..253: note = UROKINASE-TYPE PLASMINOGEN ACTIVATOR (u-PA) protease domain R35W/R36H/H37S/V38E/T39Y/V41R/Y60bN/T97aE/L97bA/H9 9Q/C122S/Y149R/M157K
IIGGEFTTIENQPWFAAIYWHSRGGSEYYRCGGSLISPCWVISATHCFIDNPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 674 - protein, 253 aa, synthetic construct
  REGION 1..253: note = UROKINASE-TYPE PLASMINOGEN ACTIVATOR (u-PA) protease domain F30Y/R35W/R36H/H37S/V38E/Y40H/Y60bN/T97aI/L97bA/H9 9Q/C122S/Y149R
IIGGEFTTIENQPWYAAIYWHSRGGSETHVCGGSLISPCWVISATHCFIDNPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 675 - protein, 253 aa, synthetic construct
  REGION 1..253: note = UROKINASE-TYPE PLASMINOGEN ACTIVATOR (u-PA) protease domain R35W/R36N/H37S/V38E/T39Y/Y40M/V41R/Y60bN/T97aE/L97 bA/H99Q/C122S/Y149R/M157S
IIGGEFTTIENQPWFAAIYWNSRGGSEYMRCGGSLISPCWVISATHCFIDNPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKSTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 676 - protein, 253 aa, synthetic construct
  REGION 1..253: note = UROKINASE-TYPE PLASMINOGEN ACTIVATOR (u-PA) protease domain R35W/R36Q/H37S/V38T/T39Y/Y40H/V41R/Y60bN/T97aE/L97 bA/H99Q/C122S/Y149R/Y151P/M157R
IIGGEFTTIENQPWFAAIYWQSRGGSTYHRCGGSLISPCWVISATHCFIDNPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLPPEQLKRTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 677 - protein, 253 aa, synthetic construct
  REGION 1..253: note = UROKINASE-TYPE PLASMINOGEN ACTIVATOR (u-PA) protease domain F30Y/R35W/R36Q/H37S/V38P/T39Y/Y40L/V41R/Y60bN/T97a E/L97bA/H99Q/C122S/Y149R/M157R
IIGGEFTTIENQPWYAAIYWQSRGGSPYLRCGGSLISPCWVISATHCFIDNPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKRTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 678 - protein, 253 aa, synthetic construct
  REGION 1..253: note = UROKINASE-TYPE PLASMINOGEN ACTIVATOR (u-PA) protease domain R35W/R36Q/H37S/V38P/T39Y/V41R/Y60bN/T97aE/L97bA/H9 9Q/C122S/Y149R/Y151L
IIGGEFTTIENQPWFAAIYWQSRGGSPYYRCGGSLISPCWVISATHCFIDNPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLLPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 679 - protein, 253 aa, synthetic construct
  REGION 1..253: note = UROKINASE-TYPE PLASMINOGEN ACTIVATOR (u-PA) protease domain F30H/R35W/R36T/H37S/V38P/T39Y/V41R/Y60bN/T97aE/L97 bA/H99Q/C122S/Y149R/Y151L/M157S
IIGGEFTTIENQPWHAAIYWTSRGGSPYYRCGGSLISPCWVISATHCFIDNPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLLPEQLKSTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 680 - protein, 253 aa, synthetic construct
  REGION 1..253: note = UROKINASE-TYPE PLASMINOGEN ACTIVATOR (u-PA) protease domain F30Y/R35W/R36Q/H37S/V38E/T39Y/Y40L/V41R/Y60bN/T97a E/L97bA/H99Q/C122S/Y149R/Y151L/M157T/Q192H
IIGGEFTTIENQPWYAAIYWQSRGGSEYLRCGGSLISPCWVISATHCFIDNPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLLPEQLKTTVVKLISHRECQQPHYYGSEVTTKMLCAADPQWKTDSCHGDSGGPLVCSLQGRMTLTGIVSWGRGCALKDKPGVYTRVSHFLPWIRSHTKEENGLAL

SEQ ID NO: 681 - protein, 253 aa, synthetic construct
  REGION 1..253: note = UROKINASE-TYPE PLASMINOGEN ACTIVATOR (u-PA) protease domain F30Y/R35W/R36K/H37S/V38D/T39Y/Y40L/V41R/Y60bN/T97a E/L97bA/H99Q/C122S/Y149R/Y151L/M157R/Q192T
IIGGEFTTIENQPWYAAIYWKSRGGSDYLRCGGSLISPCWVISATHCFIDNPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLLPEQLKRTVVKLISHRECQQPHYYGSEVTTKMLCAADPQWKTDSCTGDSGGPLVCSLQGRMTLTGIVSWGRGCALKDKPGVYTRVSHFLPWIRSHTKEENGLAL

SEQ ID NO: 682 - protein, 253 aa, synthetic construct
  REGION 1..253: note = UROKINASE-TYPE PLASMINOGEN ACTIVATOR (u-PA) protease domain R35W/R36K/H37S/V38E/T39Y/Y40L/V41R/Y60bN/T97aE/L97 bA/H99Q/C122S/Y149R/Y151L/M157S/Q192H
IIGGEFTTIENQPWFAAIYWKSRGGSEYLRCGGSLISPCWVISATHCFIDNPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLLPEQLKSTVVKLISHRECQQPHYYGSEVTTKMLCAADPQWKTDSCHGDSGGPLVCSLQGRMTLTGIVSWGRGCALKDKPGVYTRVSHFLPWIRSHTKEENGLAL

SEQ ID NO: 683 - protein, 253 aa, synthetic construct
  REGION 1..253: note = UROKINASE-TYPE PLASMINOGEN ACTIVATOR (u-PA) protease domain F30Y/R35W/R36S/H37S/V38Q/T39Y/Y40L/V41R/Y60bN/T97a E/L97bA/H99Q/C122S/Y149R/Y151L/M157S/Q192N
IIGGEFTTIENQPWYAAIYWSSRGGSQYLRCGGSLISPCWVISATHCFIDNPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLLPEQLKSTVVKLISHRECQQPHYYGSEVTTKMLCAADPQWKTDSCNGDSGGPLVCSLQGRMTLTGIVSWGRGCALKDKPGVYTRVSHFLPWIRSHTKEENGLAL

SEQ ID NO: 684 - protein, 253 aa, synthetic construct
  REGION 1..253: note = UROKINASE-TYPE PLASMINOGEN ACTIVATOR (u-PA) protease domain F30Y/R35W/R36Q/H37S/V38T/T39Y/Y40L/V41R/Y60bN/T97a E/L97bA/H99Q/C122S/Y149R/Y151L/M157K/Q192T
IIGGEFTTIENQPWYAAIYWQSRGGSTYLRCGGSLISPCWVISATHCFIDNPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLLPEQLKKTVVKLISHRECQQPHYYGSEVTTKMLCAADPQWKTDSCTGDSGGPLVCSLQGRMTLTGIVSWGRGCALKDKPGVYTRVSHFLPWIRSHTKEENGLAL

SEQ ID NO: 685 - protein, 253 aa, synthetic construct
  REGION 1..253: note = UROKINASE-TYPE PLASMINOGEN ACTIVATOR (u-PA) protease domain R35W/R36K/H37S/V38A/T39Y/V41R/Y60bN/T97aE/L97bA/H9 9Q/C122S/Y149R/Y151L/M157R/Q192T
IIGGEFTTIENQPWFAAIYWKSRGGSAYYRCGGSLISPCWVISATHCFIDNPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLLPEQLKRTVVKLISHRECQQPHYYGSEVTTKMLCAADPQWKTDSCTGDSGGPLVCSLQGRMTLTGIVSWGRGCALKDKPGVYTRVSHFLPWIRSHTKEENGLAL

SEQ ID NO: 686 - protein, 253 aa, synthetic construct
  REGION 1..253: note = UROKINASE-TYPE PLASMINOGEN ACTIVATOR (u-PA) protease domain F30Y/R35W/R36H/H37S/V38E/T39Y/Y40H/V41R/Y60bN/T97a E/L97bA/H99Q/C122S/Y149R/Y151P/M157K/Q192H
IIGGEFTTIENQPWYAAIYWHSRGGSEYHRCGGSLISPCWVISATHCFIDNPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLPPEQLKKTVVKLISHRECQQPHYYGSEVTTKMLCAADPQWKTDSCHGDSGGPLVCSLQGRMTLTGIVSWGRGCALKDKPGVYTRVSHFLPWIRSHTKEENGLAL

SEQ ID NO: 687 - protein, 253 aa, synthetic construct
  REGION 1..253: note = UROKINASE-TYPE PLASMINOGEN ACTIVATOR (u-PA) protease domain R35W/R36Q/H37S/V38E/T39Y/Y40L/V41R/Y60bN/T97aE/L97 bA/H99Q/C122S/Y149R/Y151L/M157S/Q192T
IIGGEFTTIENQPWFAAIYWQSRGGSEYLRCGGSLISPCWVISATHCFIDNPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLLPEQLKSTVVKLISHRECQQPHYYGSEVTTKMLCAADPQWKTDSCTGDSGGPLVCSLQGRMTLTGIVSWGRGCALKDKPGVYTRVSHFLPWIRSHTKEENGLAL

SEQ ID NO: 688 - protein, 253 aa, synthetic construct
  REGION 1..253: note = UROKINASE-TYPE PLASMINOGEN ACTIVATOR (u-PA) protease domain R35W/R36Q/H37S/V38S/T39Y/V41R/Y60bN/T97aE/L97bA/H9 9Q/C122S/Y149R/Y151L/M157S/Q192H
IIGGEFTTIENQPWFAAIYWQSRGGSSYYRCGGSLISPCWVISATHCFIDNPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLLPEQLKSTVVKLISHRECQQPHYYGSEVTTKMLCAADPQWKTDSCHGDSGGPLVCSLQGRMTLTGIVSWGRGCALKDKPGVYTRVSHFLPWIRSHTKEENGLAL

SEQ ID NO: 689 - protein, 253 aa, synthetic construct
  REGION 1..253: note = UROKINASE-TYPE PLASMINOGEN ACTIVATOR (u-PA) protease domain F30H/R35W/R36H/H37S/V38E/T39Y/Y40M/V41R/Y60bN/T97a E/L97bA/H99Q/C122S/Y149R/M157K
IIGGEFTTIENQPWHAAIYWHSRGGSEYMRCGGSLISPCWVISATHCFIDNPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 690 - protein, 253 aa, synthetic construct
  REGION 1..253: note = UROKINASE-TYPE PLASMINOGEN ACTIVATOR (u-PA) protease domain F30Y/R35W/R36T/H37S/V38S/T39Y/Y40L/V41R/Y60bN/T97a E/L97bA/H99Q/C122S/Y149R/Y151L/M157R/Q192Y
IIGGEFTTIENQPWYAAIYWTSRGGSSYLRCGGSLISPCWVISATHCFIDNPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLLPEQLKRTVVKLISHRECQQPHYYGSEVTTKMLCAADPQWKTDSCYGDSGGPLVCSLQGRMTLTGIVSWGRGCALKDKPGVYTRVSHFLPWIRSHTKEENGLAL

SEQ ID NO: 691 - protein, 253 aa, synthetic construct
  REGION 1..253: note = UROKINASE-TYPE PLASMINOGEN ACTIVATOR (u-PA) protease domain F30Y/R35L/R36H/H37E/V38E/T39S/Y40F/V41R/T97aI/L97b A/H99Q/C122S/Y149R/M157K
IIGGEFTTIENQPWYAAIYLHERGGSESFRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 692 - protein, 253 aa, synthetic construct
  REGION 1..253: note = UROKINASE-TYPE PLASMINOGEN ACTIVATOR (u-PA) protease domain F30Y/R35V/R36H/H37T/V38E/T39A/Y40L/V41Q/T97aI/L97b A/H99Q/C122S/Y149R/M157K
IIGGEFTTIENQPWYAAIYVHTRGGSEALQCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 693 - protein, 253 aa, synthetic construct
  REGION 1..253: note = UROKINASE-TYPE PLASMINOGEN ACTIVATOR (u-PA) protease domain F30Y/R35K/R36H/H37E/R37aK/V38E/T39F/Y40F/V41R/D60a P/Y60bS/T97aI/L97bA/H99Q/C122S/Y149R/M157K
IIGGEFTTIENQPWYAAIYKHEKGGSEFFRCGGSLISPCWVISATHCFIPSPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 694 - protein, 253 aa, synthetic construct
  REGION 1..253: note = UROKINASE-TYPE PLASMINOGEN ACTIVATOR (u-PA) protease domain F30Y/R35Q/R36H/H37G/R37aE/V38E/T39Y/Y40F/V41R/D60a P/Y60bG/T97aI/L97bA/H99Q/C122S/Y149R/M157K
IIGGEFTTIENQPWYAAIYQHGEGGSEYFRCGGSLISPCWVISATHCFIPGPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 695 - protein, 253 aa, synthetic construct
  REGION 1..253: note = UROKINASE-TYPE PLASMINOGEN ACTIVATOR (u-PA) protease domain F30Y/R35Q/R36H/H37G/R37aE/V38E/T39I/Y40F/V41R/D60a P/Y60bD/T97aI/L97bA/H99Q/C122S/Y149M/M157K
IIGGEFTTIENQPWYAAIYQHGEGGSEIFRCGGSLISPCWVISATHCFIPDPKKEDYIVYLGRSRLNSNTQGEMKFEVENLILHKDYSADIAAQHNDIALLKIRSKEGRCAQPSRTIQTISLPSMYNDPQFGTSCEITGFGKENSTDMLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 696 - protein, 253 aa, synthetic construct
  REGION 1..253: note = UROKINASE-TYPE PLASMINOGEN ACTIVATOR (u-PA) protease domain F30Y/R35H/R36H/H37D/R37aE/V38E/T39Y/Y40F/V41R/D60a P/Y60bD/T97aI/L97bA/H99Q/C122S/Y149R/M157K
IIGGEFTTIENQPWYAAIYHHDEGGSEYFRCGGSLISPCWVISATHCFIPDPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 697 - protein, 253 aa, synthetic construct
  REGION 1..253: note = UROKINASE-TYPE PLASMINOGEN ACTIVATOR (u-PA) protease domain H37M/R37aD/V38E/T39A/V41R/D60aP/Y60bS/T97aI/L97bA/ H99Q/C122S/Y149R
IIGGEFTTIENQPWFAAIYRRMDGGSEAYRCGGSLISPCWVISATHCFIPSPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 698 - protein, 253 aa, synthetic construct
  REGION 1..253: note = UROKINASE-TYPE PLASMINOGEN ACTIVATOR (u-PA) protease domain R35F/H37D/R37aS/V38E/T39Y/V41R/D60aE/Y60bD/T97aI/L 97bA/H99Q/C122S/Y149R
IIGGEFTTIENQPWFAAIYFRDSGGSEYYRCGGSLISPCWVISATHCFIEDPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 699 - protein, 253 aa, synthetic construct
  REGION 1..253: note = UROKINASE-TYPE PLASMINOGEN ACTIVATOR (u-PA) protease domain R35A/H37D/R37aN/V38E/T39F/V41R/D60aP/Y60bD/T97aI/L 97bA/H99Q/C122S/Y149R
IIGGEFTTIENQPWFAAIYARDNGGSEFYRCGGSLISPCWVISATHCFIPDPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 700 - protein, 253 aa, synthetic construct
  REGION 1..253: note = UROKINASE-TYPE PLASMINOGEN ACTIVATOR (u-PA) protease domain R35Q/H37D/R37aA/V38E/T39F/V41R/D60aP/Y60bE/T97aI/L 97bA/H99Q/C122S/Y149R
IIGGEFTTIENQPWFAAIYQRDAGGSEFYRCGGSLISPCWVISATHCFIPEPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 701 - protein, 253 aa, synthetic construct
  REGION 1..253: note = UROKINASE-TYPE PLASMINOGEN ACTIVATOR (u-PA) protease domain R35W/H37D/R37aP/V38E/T39W/V41R/D60aR/Y60bS/T97aI/L 97bA/H99Q/C122S/Y149R
IIGGEFTTIENQPWFAAIYWRDPGGSEWYRCGGSLISPCWVISATHCFIRSPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 702 - protein, 253 aa, synthetic construct
  REGION 1..253: note = UROKINASE-TYPE PLASMINOGEN ACTIVATOR (u-PA) protease domain R35F/H37D/R37aN/V38E/T39Y/V41R/Y60bS/T97aI/L97bA/H 99Q/C122S/Y149R
IIGGEFTTIENQPWFAAIYFRDNGGSEYYRCGGSLISPCWVISATHCFIDSPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 703 - protein, 253 aa, synthetic construct
  REGION 1..253: note = UROKINASE-TYPE PLASMINOGEN ACTIVATOR (u-PA) protease domain R35Y/H37S/R37aP/V38E/T39Y/V41R/D60aP/Y60bD/T97aI/L 97bA/H99Q/C122S/Y149R
IIGGEFTTIENQPWFAAIYYRSPGGSEYYRCGGSLISPCWVISATHCFIPDPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 704 - protein, 253 aa, synthetic construct
  REGION 1..253: note = UROKINASE-TYPE PLASMINOGEN ACTIVATOR (u-PA) protease domain R35Q/H37Y/R37aD/V38E/T39L/V41R/D60aE/Y60bT/T97aI/L 97bA/H99Q/C122S/Y149R
IIGGEFTTIENQPWFAAIYQRYDGGSELYRCGGSLISPCWVISATHCFIETPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 705 - protein, 253 aa, synthetic construct
  REGION 1..253: note = UROKINASE-TYPE PLASMINOGEN ACTIVATOR (u-PA) protease domain R35W/H37P/R37aG/V38E/T39Y/V41R/D60aP/Y60bE/T97aI/L 97bA/H99Q/C122S/Y149R
IIGGEFTTIENQPWFAAIYWRPGGGSEYYRCGGSLISPCWVISATHCFIPEPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 706 - protein, 253 aa, synthetic construct
  REGION 1..253: note = UROKINASE-TYPE PLASMINOGEN ACTIVATOR (u-PA) protease domain N26D/F30Y/R35Y/R36H/H37E/V38E/T39F/Y40F/V41R/K61E/ T97aI/L97bA/H99Q/R110dS/P114S/C122S/Y149R/M157K
IIGGEFTTIEDQPWYAAIYYHERGGSEFFRCGGSLISPCWVISATHCFIDYPEKEDYIVYLGRSRLNSNTQGEMKFEVENLILHKDYSADIAAQHNDIALLKIRSKEGSCAQSSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 707 - protein, 253 aa, synthetic construct
  REGION 1..253: note = UROKINASE-TYPE PLASMINOGEN ACTIVATOR (u-PA) protease domain F30Y/R35Y/R36H/H37N/V38E/T39F/Y40F/V41R/K61E/R72H/ T97aI/L97bA/H99Q/C122S/Y149R/M157K/Q169K
IIGGEFTTIENQPWYAAIYYHNRGGSEFFRCGGSLISPCWVISATHCFIDYPEKEDYIVYLGRSHLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECKQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 708 - protein, 253 aa, synthetic construct
  REGION 1..253: note = UROKINASE-TYPE PLASMINOGEN ACTIVATOR (u-PA) protease domain F30Y/R35Y/R36H/H37E/V38E/T39F/Y40F/V41R/K61E/T97aI /L97bA/H99Q/C122S/Y149R/M157K/T242A
IIGGEFTTIENQPWYAAIYYHERGGSEFFRCGGSLISPCWVISATHCFIDYPEKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHAKEENGLAL

SEQ ID NO: 709 - protein, 253 aa, synthetic construct
  REGION 1..253: note = UROKINASE-TYPE PLASMINOGEN ACTIVATOR (u-PA) protease domain F30Y/R35Q/R36H/H37G/R37aE/V38E/T39F/Y40F/V41R/D60a S/Y60bP/T97aE/L97bA/H99Q/C122S/Y149R/M157K
IIGGEFTTIENQPWYAAIYQHGEGGSEFFRCGGSLISPCWVISATHCFISPPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 710 - protein, 253 aa, synthetic construct
  REGION 1..253: note = UROKINASE-TYPE PLASMINOGEN ACTIVATOR (u-PA) protease domain F30Y/R35M/R36H/H37D/R37aD/V38E/T39Y/Y40F/V41R/D60a P/Y60bS/T97aE/L97bA/H99Q/C122S/Y149R/M157K
IIGGEFTTIENQPWYAAIYMHDDGGSEYFRCGGSLISPCWVISATHCFIPSPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 711 - protein, 253 aa, synthetic construct
  REGION 1..253: note = UROKINASE-TYPE PLASMINOGEN ACTIVATOR (u-PA) protease domain F30Y/R35Q/R36H/H37G/R37aN/V38E/T39Y/Y40F/V41R/Y60b A/T97aE/L97bA/H99Q/C122S/Y149R/M157K
IIGGEFTTIENQPWYAAIYQHGNGGSEYFRCGGSLISPCWVISATHCFIDAPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 712 - protein, 253 aa, synthetic construct
  REGION 1..253: note = UROKINASE-TYPE PLASMINOGEN ACTIVATOR (u-PA) protease domain F30Y/R35Q/R36H/H37G/R37aE/V38E/T39Y/Y40F/V41R/D60a P/Y60bS/T97aE/L97bA/H99Q/C122S/Y149R/M157K
IIGGEFTTIENQPWYAAIYQHGEGGSEYFRCGGSLISPCWVISATHCFIPSPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 713 - protein, 253 aa, synthetic construct
  REGION 1..253: note = UROKINASE-TYPE PLASMINOGEN ACTIVATOR (u-PA) protease domain F30Y/R35W/R36H/H37D/R37aE/V38E/T39Y/Y40F/V41R/D60a E/Y60bF/T97aE/L97bA/H99Q/C122S/Y149R/M157K
IIGGEFTTIENQPWYAAIYWHDEGGSEYFRCGGSLISPCWVISATHCFIEFPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 714 - protein, 253 aa, synthetic construct
  REGION 1..253: note = UROKINASE-TYPE PLASMINOGEN ACTIVATOR (u-PA) protease domain F30Y/R35Q/R36H/H37Y/R37aE/V38E/T39Y/Y40F/V41R/D60a S/Y60bP/T97aE/L97bA/H99Q/C122S/Y149R/M157K
IIGGEFTTIENQPWYAAIYQHYEGGSEYFRCGGSLISPCWVISATHCFISPPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 715 - protein, 253 aa, synthetic construct
  REGION 1..253: note = UROKINASE-TYPE PLASMINOGEN ACTIVATOR (u-PA) protease domain F30Y/R35Q/R36H/H37Y/R37aD/V38E/T39Y/Y40F/V41R/Y60b V/T97aE/L97bA/H99Q/C122S/Y149R/M157K
IIGGEFTTIENQPWYAAIYQHYDGGSEYFRCGGSLISPCWVISATHCFIDVPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 716 - protein, 253 aa, synthetic construct
  REGION 1..253: note = UROKINASE-TYPE PLASMINOGEN ACTIVATOR (u-PA) protease domain F30Y/R35A/R36H/H37T/R37aD/V38E/T39Y/Y40L/V41R/D60a P/Y60bE/T97aE/L97bA/H99Q/C122S/Y149R/M157K
IIGGEFTTIENQPWYAAIYAHTDGGSEYLRCGGSLISPCWVISATHCFIPEPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 717 - protein, 253 aa, synthetic construct
  REGION 1..253: note = UROKINASE-TYPE PLASMINOGEN ACTIVATOR (u-PA) protease domain F30Y/R35W/R36H/H37S/V38E/T39Y/Y40F/V41R/Y60bN/T97a E/L97bA/H99Q/C122S/N145S/S146V/T147M/D148G/Y149Q/L150F/M157 K
IIGGEFTTIENQPWYAAIYWHSRGGSEYFRCGGSLISPCWVISATHCFIDNPKKEDYIVYLGRSRLNSNTQGEMKFEVENLILHKDYSADEAAQHNDIALLKIRSKEGRCAQPSRTIQTISLPSMYNDPQFGTSCEITGFGKESVMGQFYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 718 - protein, 253 aa, synthetic construct
  REGION 1..253: note = UROKINASE-TYPE PLASMINOGEN ACTIVATOR (u-PA) protease domain F30Y/R35Q/R36H/H37G/R37aE/V38E/T39F/Y40F/V41R/D60a P/Y60bS/T97aE/L97bA/H99Q/C122S/Y149R/M157K
IIGGEFTTIENQPWYAAIYQHGEGGSEFFRCGGSLISPCWVISATHCFIPSPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 719 - protein, 253 aa, synthetic construct
  REGION 1..253: note = UROKINASE-TYPE PLASMINOGEN ACTIVATOR (u-PA) protease domain F30Y/R35Q/R36H/H37G/R37aL/V38E/T39N/Y40F/V41R/D60a P/Y60bT/T97aE/L97bA/H99Q/C122S/Y149R/M157K
IIGGEFTTIENQPWYAAIYQHGLGGSENFRCGGSLISPCWVISATHCFIPTPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 720 - protein, 253 aa, synthetic construct
  REGION 1..253: note = UROKINASE-TYPE PLASMINOGEN ACTIVATOR (u-PA) protease domain F30Y/R35E/R36H/H37D/R37aN/V38E/T39Y/Y40F/V41R/Y60b N/T97aE/L97bA/H99Q/C122S/Y149R/M157K
IIGGEFTTIENQPWYAAIYEHDNGGSEYFRCGGSLISPCWVISATHCFIDNPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 721 - protein, 253 aa, synthetic construct
  REGION 1..253: note = UROKINASE-TYPE PLASMINOGEN ACTIVATOR (u-PA) protease domain F30Y/R36H/H37M/R37aD/V38E/T39G/Y40F/V41R/D60aP/Y60 bE/T97aE/L97bA/H99Q/C122S/Y149R/M157K
IIGGEFTTIENQPWYAAIYRHMDGGSEGFRCGGSLISPCWVISATHCFIPEPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 722 - protein, 253 aa, synthetic construct
  REGION 1..253: note = UROKINASE-TYPE PLASMINOGEN ACTIVATOR (u-PA) protease domain F30Y/R35W/R36H/H37E/R37aP/V38E/T39Y/Y40F/V41R/Y60b N/T97aE/L97bA/H99Q/C122S/Y149Q/M157K
IIGGEFTTIENQPWYAAIYWHEPGGSEYFRCGGSLISPCWVISATHCFIDNPKKEDYIVYLGRSRLNSNTQGEMKFEVENLILHKDYSADEAAQHNDIALLKIRSKEGRCAQPSRTIQTISLPSMYNDPQFGTSCEITGFGKENSTDQLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 723 - protein, 253 aa, synthetic construct
  REGION 1..253: note = UROKINASE-TYPE PLASMINOGEN ACTIVATOR (u-PA) protease domain F30Y/R35Q/R36H/H37D/R37aE/V38E/T39Y/Y40F/V41R/D60a E/Y60bG/T97aE/L97bA/H99Q/C122S/Y149R/M157K
IIGGEFTTIENQPWYAAIYQHDEGGSEYFRCGGSLISPCWVISATHCFIEGPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 724 - protein, 253 aa, synthetic construct
  REGION 1..253: note = UROKINASE-TYPE PLASMINOGEN ACTIVATOR (u-PA) protease domain F30Y/R35Y/R36H/H37P/R37aQ/V38E/T39Y/Y40F/V41R/Y60b H/T97aE/L97bA/H99Q/C122S/Y149R/M157K
IIGGEFTTIENQPWYAAIYYHPQGGSEYFRCGGSLISPCWVISATHCFIDHPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 725 - protein, 253 aa, synthetic construct
  REGION 1..253: note = UROKINASE-TYPE PLASMINOGEN ACTIVATOR (u-PA) protease domain F30Y/R35F/R36H/H37D/R37aD/V38E/T39H/Y40F/V41R/D60a P/Y60bA/T97aE/L97bA/H99Q/C122S/Y149R/M157K
IIGGEFTTIENQPWYAAIYFHDDGGSEHFRCGGSLISPCWVISATHCFIPAPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 726 - protein, 253 aa, synthetic construct
  REGION 1..253: note = UROKINASE-TYPE PLASMINOGEN ACTIVATOR (u-PA) protease domain F30Y/R35Q/R36H/H37Y/R37aE/V38E/T39Y/Y40F/V41R/D60a E/Y60bA/T97aE/L97bA/H99Q/C122S/Y149R/M157K
IIGGEFTTIENQPWYAAIYQHYEGGSEYFRCGGSLISPCWVISATHCFIEAPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 727 - protein, 253 aa, synthetic construct
  REGION 1..253: note = UROKINASE-TYPE PLASMINOGEN ACTIVATOR (u-PA) protease domain F30Y/R35W/R36H/H37P/R37aD/V38E/T39Y/Y40F/V41R/D60a E/Y60bS/T97aE/L97bA/H99Q/C122S/Y149R/M157K
IIGGEFTTIENQPWYAAIYWHPDGGSEYFRCGGSLISPCWVISATHCFIESPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 728 - protein, 253 aa, synthetic construct
  REGION 1..253: note = UROKINASE-TYPE PLASMINOGEN ACTIVATOR (u-PA) protease domain F30Y/R35Q/R36H/H37G/R37aE/V38E/T39Y/Y40F/V41R/D60a A/Y60bS/T97aE/L97bA/H99Q/C122S/Y149R/M157K
IIGGEFTTIENQPWYAAIYQHGEGGSEYFRCGGSLISPCWVISATHCFIASPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 729 - protein, 253 aa, synthetic construct
  REGION 1..253: note = UROKINASE-TYPE PLASMINOGEN ACTIVATOR (u-PA) protease domain F30Y/R35M/R36H/H37G/R37aE/V38E/T39Y/Y40F/V41R/D60a P/Y60bS/T97aE/L97bA/H99Q/C122S/Y149R/M157K
IIGGEFTTIENQPWYAAIYMHGEGGSEYFRCGGSLISPCWVISATHCFIPSPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 730 - protein, 253 aa, synthetic construct
  REGION 1..253: note = UROKINASE-TYPE PLASMINOGEN ACTIVATOR (u-PA) protease domain F30Y/R36H/H37D/R37aE/V38E/T39Y/Y40F/V41R/Y60bN/T97 aE/L97bA/H99Q/C122S/Y149R/M157K
IIGGEFTTIENQPWYAAIYRHDEGGSEYFRCGGSLISPCWVISATHCFIDNPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 731 - protein, 253 aa, synthetic construct
  REGION 1..253: note = UROKINASE-TYPE PLASMINOGEN ACTIVATOR (u-PA) protease domain F30Y/R35W/R36H/H37P/R37aQ/V38E/T39Y/Y40F/V41R/Y60b Q/T97aE/L97bA/H99Q/C122S/Y149R/M157K
IIGGEFTTIENQPWYAAIYWHPQGGSEYFRCGGSLISPCWVISATHCFIDQPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 732 - protein, 253 aa, synthetic construct
  REGION 1..253: note = UROKINASE-TYPE PLASMINOGEN ACTIVATOR (u-PA) protease domain F30Y/R35W/R36H/H37P/R37aE/V38E/T39Y/Y40F/V41R/Y60b A/T97aE/L97bA/H99Q/C122S/Y149R/M157K
IIGGEFTTIENQPWYAAIYWHPEGGSEYFRCGGSLISPCWVISATHCFIDAPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKKTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 733 - protein, 253 aa, synthetic construct
  REGION 1..253: note = UROKINASE-TYPE PLASMINOGEN ACTIVATOR (u-PA) protease domain R35Q/H37Y/R37aE/V38E/T39Y/V41R/D60aA/Y60bP/T97aI/L 97bA/H99Q/C122S/Y149R
IIGGEFTTIENQPWFAAIYQRYEGGSEYYRCGGSLISPCWVISATHCFIAPPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 734 - protein, 253 aa, synthetic construct
  REGION 1..253: note = UROKINASE-TYPE PLASMINOGEN ACTIVATOR (u-PA) protease domain R35L/H37D/R37aS/V38E/T39Y/V41R/D60aP/Y60bD/T97aI/L 97bA/H99Q/C122S/Y149R
IIGGEFTTIENQPWFAAIYLRDSGGSEYYRCGGSLISPCWVISATHCFIPDPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 735 - protein, 253 aa, synthetic construct
  REGION 1..253: note = UROKINASE-TYPE PLASMINOGEN ACTIVATOR (u-PA) protease domain R35M/H37G/R37aD/V38E/T39W/V41R/D60aP/Y60bD/T97aI/L 97bA/H99Q/C122S/Y149R
IIGGEFTTIENQPWFAAIYMRGDGGSEWYRCGGSLISPCWVISATHCFIPDPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 736 - protein, 253 aa, synthetic construct
  REGION 1..253: note = UROKINASE-TYPE PLASMINOGEN ACTIVATOR (u-PA) protease domain R35Q/H37G/R37aP/V38E/T39Y/V41R/D60aP/Y60bE/T97aI/L 97bA/H99Q/C122S/Y149R
IIGGEFTTIENQPWFAAIYQRGPGGSEYYRCGGSLISPCWVISATHCFIPEPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 737 - protein, 253 aa, synthetic construct
  REGION 1..253: note = UROKINASE-TYPE PLASMINOGEN ACTIVATOR (u-PA) protease domain R35A/H37G/R37aE/V38E/T39F/V41R/D60aE/Y60bP/T97aI/L 97bA/H99Q/C122S/Y149R
IIGGEFTTIENQPWFAAIYARGEGGSEFYRCGGSLISPCWVISATHCFIEPPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 738 - protein, 253 aa, synthetic construct
  REGION 1..253: note = UROKINASE-TYPE PLASMINOGEN ACTIVATOR (u-PA) protease domain R35Q/H37S/R37aE/V38E/T39Y/V41R/D60aP/Y60bS/T97aI/L 97bA/H99Q/C122S/Y149R
IIGGEFTTIENQPWFAAIYQRSEGGSEYYRCGGSLISPCWVISATHCFIPSPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 739 - protein, 253 aa, synthetic construct
  REGION 1..253: note = UROKINASE-TYPE PLASMINOGEN ACTIVATOR (u-PA) protease domain R35Q/H37T/R37aP/V38E/T39Y/V41R/D60aE/Y60bD/T97aI/L 97bA/H99Q/C122S/Y149R
IIGGEFTTIENQPWFAAIYQRTPGGSEYYRCGGSLISPCWVISATHCFIEDPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 740 - protein, 253 aa, synthetic construct
  REGION 1..253: note = UROKINASE-TYPE PLASMINOGEN ACTIVATOR (u-PA) protease domain R35Q/H37G/R37aE/V38E/T39H/V41R/D60aP/Y60bA/T97aI/L 97bA/H99Q/C122S/Y149R
IIGGEFTTIENQPWFAAIYQRGEGGSEHYRCGGSLISPCWVISATHCFIPAPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 741 - protein, 253 aa, synthetic construct
  REGION 1..253: note = UROKINASE-TYPE PLASMINOGEN ACTIVATOR (u-PA) protease domain R35W/H37D/R37aS/V38E/T39Y/V41R/D60aE/Y60bS/T97aI/L 97bA/H99Q/C122S/Y149R
IIGGEFTTIENQPWFAAIYWRDSGGSEYYRCGGSLISPCWVISATHCFIESPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 742 - protein, 253 aa, synthetic construct
  REGION 1..253: note = UROKINASE-TYPE PLASMINOGEN ACTIVATOR (u-PA) protease domain R35Q/H37G/R37aE/V38E/T39Y/V41R/D60aP/Y60bT/T97aI/L 97bA/H99Q/C122S/Y149R
IIGGEFTTIENQPWFAAIYQRGEGGSEYYRCGGSLISPCWVISATHCFIPTPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 743 - protein, 253 aa, synthetic construct
  REGION 1..253: note = UROKINASE-TYPE PLASMINOGEN ACTIVATOR (u-PA) protease domain R35Q/H37Y/R37aE/V38E/T39Y/V41R/D60aG/Y60bS/T97aI/L 97bA/H99Q/C122S/Y149R
IIGGEFTTIENQPWFAAIYQRYEGGSEYYRCGGSLISPCWVISATHCFIGSPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 744 - protein, 253 aa, synthetic construct
  REGION 1..253: note = UROKINASE-TYPE PLASMINOGEN ACTIVATOR (u-PA) protease domain R35W/H37P/R37aN/V38E/T39Y/V41R/D60aP/Y60bL/D97T/T9 7aE/L97bG/A98S/H99L/C122S
IIGGEFTTIENQPWFAAIYWRPNGGSEYYRCGGSLISPCWVISATHCFIPLPKKEDYIVYLGRSRLNSNTQGEMKFEVENLILHKDYSATEGSLHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 745 - protein, 253 aa, synthetic construct
  REGION 1..253: note = UROKINASE-TYPE PLASMINOGEN ACTIVATOR (u-PA) protease domain R35W/H37P/R37aN/V38E/T39Y/V41K/D60aP/Y60bD/T97aI/L 97bA/H99Q/C122S/Y151L/Q192A
IIGGEFTTIENQPWFAAIYWRPNGGSEYYKCGGSLISPCWVISATHCFIPDPKKEDYIVYLGRSRLNSNTQGEMKFEVENLILHKDYSADIAAQHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCAGDSGGPLVCSLQGRMTLTGIVSWGRGCALKDKPGVYTRVSHFLPWIRSHTKEENGLAL

SEQ ID NO: 746 - protein, 253 aa, synthetic construct
  REGION 1..253: note = UROKINASE-TYPE PLASMINOGEN ACTIVATOR (u-PA) protease domain R35Y/H37V/R37aW/V38E/T39Y/V41R/D60aP/Y60bE/T97aI/L 97bA/H99Q/C122S/Y151L/Q192T
IIGGEFTTIENQPWFAAIYYRVWGGSEYYRCGGSLISPCWVISATHCFIPEPKKEDYIVYLGRSRLNSNTQGEMKFEVENLILHKDYSADIAAQHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCTGDSGGPLVCSLQGRMTLTGIVSWGRGCALKDKPGVYTRVSHFLPWIRSHTKEENGLAL

SEQ ID NO: 747 - protein, 253 aa, synthetic construct
  REGION 1..253: note = UROKINASE-TYPE PLASMINOGEN ACTIVATOR (u-PA) protease domain R35W/H37P/R37aN/V38E/T39Y/V41K/D60aP/Y60bD/T97aI/L 97bA/H99Q/C122S/Y151L/Q192T
IIGGEFTTIENQPWFAAIYWRPNGGSEYYKCGGSLISPCWVISATHCFIPDPKKEDYIVYLGRSRLNSNTQGEMKFEVENLILHKDYSADIAAQHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCTGDSGGPLVCSLQGRMTLTGIVSWGRGCALKDKPGVYTRVSHFLPWIRSHTKEENGLAL

SEQ ID NO: 748 - protein, 253 aa, synthetic construct
  REGION 1..253: note = UROKINASE-TYPE PLASMINOGEN ACTIVATOR (u-PA) protease domain H37T/R37aL/V38E/T39Y/V41R/D60aP/Y60bD/T97aI/L97bA/ H99Q/C122S/Y151L/Q192R
IIGGEFTTIENQPWFAAIYRRTLGGSEYYRCGGSLISPCWVISATHCFIPDPKKEDYIVYLGRSRLNSNTQGEMKFEVENLILHKDYSADIAAQHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCRGDSGGPLVCSLQGRMTLTGIVSWGRGCALKDKPGVYTRVSHFLPWIRSHTKEENGLAL

SEQ ID NO: 749 - protein, 253 aa, synthetic construct
  REGION 1..253: note = UROKINASE-TYPE PLASMINOGEN ACTIVATOR (u-PA) protease domain R35Y/H37S/R37aP/V38E/T39Y/V41R/D60aP/Y60bD/T97aI/L 97bA/H99Q/C122S/Y151L
IIGGEFTTIENQPWFAAIYYRSPGGSEYYRCGGSLISPCWVISATHCFIPDPKKEDYIVYLGRSRLNSNTQGEMKFEVENLILHKDYSADIAAQHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 750 - protein, 253 aa, synthetic construct
  REGION 1..253: note = UROKINASE-TYPE PLASMINOGEN ACTIVATOR (u-PA) protease domain R35Y/H37S/R37aP/V38E/T39Y/V41R/D60aP/Y60bD/T97aI/L 97bA/H99Q/C122S/Y151L/Q192H
IIGGEFTTIENQPWFAAIYYRSPGGSEYYRCGGSLISPCWVISATHCFIPDPKKEDYIVYLGRSRLNSNTQGEMKFEVENLILHKDYSADIAAQHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCHGDSGGPLVCSLQGRMTLTGIVSWGRGCALKDKPGVYTRVSHFLPWIRSHTKEENGLAL

SEQ ID NO: 751 - protein, 253 aa, synthetic construct
  REGION 1..253: note = UROKINASE-TYPE PLASMINOGEN ACTIVATOR (u-PA) protease domain R35A/H37E/R37aG/V38E/T39Y/V41R/D60aP/Y60bD/T97aI/L 97bA/H99Q/C122S/Y151L
IIGGEFTTIENQPWFAAIYAREGGGSEYYRCGGSLISPCWVISATHCFIPDPKKEDYIVYLGRSRLNSNTQGEMKFEVENLILHKDYSADIAAQHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 752 - protein, 253 aa, synthetic construct
  REGION 1..253: note = UROKINASE-TYPE PLASMINOGEN ACTIVATOR (u-PA) protease domain R35W/H37G/R37aE/V38E/T39Y/V41R/D60aP/Y60bD/T97aI/L 97bA/H99Q/C122S/Y151L/Q192T
IIGGEFTTIENQPWFAAIYWRGEGGSEYYRCGGSLISPCWVISATHCFIPDPKKEDYIVYLGRSRLNSNTQGEMKFEVENLILHKDYSADIAAQHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCTGDSGGPLVCSLQGRMTLTGIVSWGRGCALKDKPGVYTRVSHFLPWIRSHTKEENGLAL

SEQ ID NO: 753 - protein, 253 aa, synthetic construct
  REGION 1..253: note = UROKINASE-TYPE PLASMINOGEN ACTIVATOR (u-PA) protease domain R35Y/H37S/R37aP/V38E/T39Y/V41R/D60aP/Y60bD/T97aI/L 97bA/H99Q/C122S
IIGGEFTTIENQPWFAAIYYRSPGGSEYYRCGGSLISPCWVISATHCFIPDPKKEDYIVYLGRSRLNSNTQGEMKFEVENLILHKDYSADIAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 754 - protein, 253 aa, synthetic construct
  REGION 1..253: note = UROKINASE-TYPE PLASMINOGEN ACTIVATOR (u-PA) protease domain R35A/H37T/R37aD/V38E/T39Y/V41R/D60aP/Y60bD/T97aI/L 97bA/H99Q/C122S/Y151L/Q192S
IIGGEFTTIENQPWFAAIYARTDGGSEYYRCGGSLISPCWVISATHCFIPDPKKEDYIVYLGRSRLNSNTQGEMKFEVENLILHKDYSADIAAQHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCSGDSGGPLVCSLQGRMTLTGIVSWGRGCALKDKPGVYTRVSHFLPWIRSHTKEENGLAL

SEQ ID NO: 755 - protein, 253 aa, synthetic construct
  REGION 1..253: note = UROKINASE-TYPE PLASMINOGEN ACTIVATOR (u-PA) protease domain V38D/L97bR/H99E/C122S/E175D/R217A/K224S
IIGGEFTTIENQPWFAAIYRRHRGGSDTYVCGGSLISPCWVISATHCFIDYPKKEDYIVYLGRSRLNSNTQGEMKFEVENLILHKDYSADTRAEHNDIALLKIRSKEGRCAQPSRTIQTISLPSMYNDPQFGTSCEITGFGKENSTDYLYPEQLKMTVVKLISHRECQQPHYYGSDVTTKMLCAADPQWKTDSCQGDSGGPLVCSLQGRMTLTGIVSWGAGCALKDSPGVYTRVSHFLPWIRSHTKEENGLAL

SEQ ID NO: 756 - protein, 253 aa, synthetic construct
  REGION 1..253: note = UROKINASE-TYPE PLASMINOGEN ACTIVATOR (u-PA) protease domain V38D/L97bR/H99E/C122S/Y172F/E175D/R217E
IIGGEFTTIENQPWFAAIYRRHRGGSDTYVCGGSLISPCWVISATHCFIDYPKKEDYIVYLGRSRLNSNTQGEMKFEVENLILHKDYSADTRAEHNDIALLKIRSKEGRCAQPSRTIQTISLPSMYNDPQFGTSCEITGFGKENSTDYLYPEQLKMTVVKLISHRECQQPHYFGSDVTTKMLCAADPQWKTDSCQGDSGGPLVCSLQGRMTLTGIVSWGEGCALKDKPGVYTRVSHFLPWIRSHTKEENGLAL

SEQ ID NO: 757 - protein, 253 aa, synthetic construct
  REGION 1..253: note = UROKINASE-TYPE PLASMINOGEN ACTIVATOR (u-PA) protease domain V38D/L97bR/H99Q/C122S/E175D/R217E/K224R
IIGGEFTTIENQPWFAAIYRRHRGGSDTYVCGGSLISPCWVISATHCFIDYPKKEDYIVYLGRSRLNSNTQGEMKFEVENLILHKDYSADTRAQHNDIALLKIRSKEGRCAQPSRTIQTISLPSMYNDPQFGTSCEITGFGKENSTDYLYPEQLKMTVVKLISHRECQQPHYYGSDVTTKMLCAADPQWKTDSCQGDSGGPLVCSLQGRMTLTGIVSWGEGCALKDRPGVYTRVSHFLPWIRSHTKEENGLAL

SEQ ID NO: 758 - protein, 253 aa, synthetic construct
  REGION 1..253: note = UROKINASE-TYPE PLASMINOGEN ACTIVATOR (u-PA) protease domain V38D/L97bR/H99E/C122S/E175D/R217A/K224Q
IIGGEFTTIENQPWFAAIYRRHRGGSDTYVCGGSLISPCWVISATHCFIDYPKKEDYIVYLGRSRLNSNTQGEMKFEVENLILHKDYSADTRAEHNDIALLKIRSKEGRCAQPSRTIQTISLPSMYNDPQFGTSCEITGFGKENSTDYLYPEQLKMTVVKLISHRECQQPHYYGSDVTTKMLCAADPQWKTDSCQGDSGGPLVCSLQGRMTLTGIVSWGAGCALKDQPGVYTRVSHFLPWIRSHTKEENGLAL

SEQ ID NO: 759 - protein, 253 aa, synthetic construct
  REGION 1..253: note = UROKINASE-TYPE PLASMINOGEN ACTIVATOR (u-PA) protease domain V38D/L97bR/H99L/C122S/E175D/R217E/K224S
IIGGEFTTIENQPWFAAIYRRHRGGSDTYVCGGSLISPCWVISATHCFIDYPKKEDYIVYLGRSRLNSNTQGEMKFEVENLILHKDYSADTRALHNDIALLKIRSKEGRCAQPSRTIQTISLPSMYNDPQFGTSCEITGFGKENSTDYLYPEQLKMTVVKLISHRECQQPHYYGSDVTTKMLCAADPQWKTDSCQGDSGGPLVCSLQGRMTLTGIVSWGEGCALKDSPGVYTRVSHFLPWIRSHTKEENGLAL

SEQ ID NO: 760 - protein, 253 aa, synthetic construct
  REGION 1..253: note = UROKINASE-TYPE PLASMINOGEN ACTIVATOR (u-PA) protease domain V38D/L97bR/H99E/C122S/E175D/R217E/K224R
IIGGEFTTIENQPWFAAIYRRHRGGSDTYVCGGSLISPCWVISATHCFIDYPKKEDYIVYLGRSRLNSNTQGEMKFEVENLILHKDYSADTRAEHNDIALLKIRSKEGRCAQPSRTIQTISLPSMYNDPQFGTSCEITGFGKENSTDYLYPEQLKMTVVKLISHRECQQPHYYGSDVTTKMLCAADPQWKTDSCQGDSGGPLVCSLQGRMTLTGIVSWGEGCALKDRPGVYTRVSHFLPWIRSHTKEENGLAL

SEQ ID NO: 761 - protein, 253 aa, synthetic construct
  REGION 1..253: note = UROKINASE-TYPE PLASMINOGEN ACTIVATOR (u-PA) protease domain V38D/L97bR/H99E/C122S/E175D/R217S/K224S
IIGGEFTTIENQPWFAAIYRRHRGGSDTYVCGGSLISPCWVISATHCFIDYPKKEDYIVYLGRSRLNSNTQGEMKFEVENLILHKDYSADTRAEHNDIALLKIRSKEGRCAQPSRTIQTISLPSMYNDPQFGTSCEITGFGKENSTDYLYPEQLKMTVVKLISHRECQQPHYYGSDVTTKMLCAADPQWKTDSCQGDSGGPLVCSLQGRMTLTGIVSWGSGCALKDSPGVYTRVSHFLPWIRSHTKEENGLAL

SEQ ID NO: 762 - protein, 253 aa, synthetic construct
  REGION 1..253: note = UROKINASE-TYPE PLASMINOGEN ACTIVATOR (u-PA) protease domain V38D/L97bR/H99V/C122S/E175D/R217E/K224N
IIGGEFTTIENQPWFAAIYRRHRGGSDTYVCGGSLISPCWVISATHCFIDYPKKEDYIVYLGRSRLNSNTQGEMKFEVENLILHKDYSADTRAVHNDIALLKIRSKEGRCAQPSRTIQTISLPSMYNDPQFGTSCEITGFGKENSTDYLYPEQLKMTVVKLISHRECQQPHYYGSDVTTKMLCAADPQWKTDSCQGDSGGPLVCSLQGRMTLTGIVSWGEGCALKDNPGVYTRVSHFLPWIRSHTKEENGLAL

SEQ ID NO: 763 - protein, 253 aa, synthetic construct
  REGION 1..253: note = UROKINASE-TYPE PLASMINOGEN ACTIVATOR (u-PA) protease domain V38D/L97bV/H99L/C122S/E175D/K224S
IIGGEFTTIENQPWFAAIYRRHRGGSDTYVCGGSLISPCWVISATHCFIDYPKKEDYIVYLGRSRLNSNTQGEMKFEVENLILHKDYSADTVALHNDIALLKIRSKEGRCAQPSRTIQTISLPSMYNDPQFGTSCEITGFGKENSTDYLYPEQLKMTVVKLISHRECQQPHYYGSDVTTKMLCAADPQWKTDSCQGDSGGPLVCSLQGRMTLTGIVSWGRGCALKDSPGVYTRVSHFLPWIRSHTKEENGLAL

SEQ ID NO: 764 - protein, 253 aa, synthetic construct
  REGION 1..253: note = UROKINASE-TYPE PLASMINOGEN ACTIVATOR (u-PA) protease domain V38D/L97bR/H99L/C122S/E175D/R217E
IIGGEFTTIENQPWFAAIYRRHRGGSDTYVCGGSLISPCWVISATHCFIDYPKKEDYIVYLGRSRLNSNTQGEMKFEVENLILHKDYSADTRALHNDIALLKIRSKEGRCAQPSRTIQTISLPSMYNDPQFGTSCEITGFGKENSTDYLYPEQLKMTVVKLISHRECQQPHYYGSDVTTKMLCAADPQWKTDSCQGDSGGPLVCSLQGRMTLTGIVSWGEGCALKDKPGVYTRVSHFLPWIRSHTKEENGLAL

SEQ ID NO: 765 - protein, 253 aa, synthetic construct
  REGION 1..253: note = UROKINASE-TYPE PLASMINOGEN ACTIVATOR (u-PA) protease domain V38D/L97bG/H99Q/C122S/E175D/R217K/K224A
IIGGEFTTIENQPWFAAIYRRHRGGSDTYVCGGSLISPCWVISATHCFIDYPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSDVTTKMLCAADPQWKTDSCQGDSGGPLVCSLQGRMTLTGIVSWGKGCALKDAPGVYTRVSHFLPWIRSHTKEENGLAL

SEQ ID NO: 766 - protein, 253 aa, synthetic construct
  REGION 1..253: note = UROKINASE-TYPE PLASMINOGEN ACTIVATOR (u-PA) protease domain V38D/L97bR/H99E/C122S/E175D/K224A
IIGGEFTTIENQPWFAAIYRRHRGGSDTYVCGGSLISPCWVISATHCFIDYPKKEDYIVYLGRSRLNSNTQGEMKFEVENLILHKDYSADTRAEHNDIALLKIRSKEGRCAQPSRTIQTISLPSMYNDPQFGTSCEITGFGKENSTDYLYPEQLKMTVVKLISHRECQQPHYYGSDVTTKMLCAADPQWKTDSCQGDSGGPLVCSLQGRMTLTGIVSWGRGCALKDAPGVYTRVSHFLPWIRSHTKEENGLAL

SEQ ID NO: 767 - protein, 253 aa, synthetic construct
  REGION 1..253: note = UROKINASE-TYPE PLASMINOGEN ACTIVATOR (u-PA) protease domain V38D/L97bR/H99E/C122S/E175D/K224S
IIGGEFTTIENQPWFAAIYRRHRGGSDTYVCGGSLISPCWVISATHCFIDYPKKEDYIVYLGRSRLNSNTQGEMKFEVENLILHKDYSADTRAEHNDIALLKIRSKEGRCAQPSRTIQTISLPSMYNDPQFGTSCEITGFGKENSTDYLYPEQLKMTVVKLISHRECQQPHYYGSDVTTKMLCAADPQWKTDSCQGDSGGPLVCSLQGRMTLTGIVSWGRGCALKDSPGVYTRVSHFLPWIRSHTKEENGLAL

SEQ ID NO: 768 - protein, 253 aa, synthetic construct
  REGION 1..253: note = UROKINASE-TYPE PLASMINOGEN ACTIVATOR (u-PA) protease domain V38D/L97bV/H99E/C122S/K224S
IIGGEFTTIENQPWFAAIYRRHRGGSDTYVCGGSLISPCWVISATHCFIDYPKKEDYIVYLGRSRLNSNTQGEMKFEVENLILHKDYSADTVAEHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDSPGVYTRVSHFLPWIRSHTKEENGLAL

SEQ ID NO: 769 - protein, 253 aa, synthetic construct
  REGION 1..253: note = UROKINASE-TYPE PLASMINOGEN ACTIVATOR (u-PA) protease domain V38D/L97bK/H99L/C122S/R217E
IIGGEFTTIENQPWFAAIYRRHRGGSDTYVCGGSLISPCWVISATHCFIDYPKKEDYIVYLGRSRLNSNTQGEMKFEVENLILHKDYSADTKALHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGEGCALKDKPGVYTRVSHFLPWIRSHTKEENGLAL

SEQ ID NO: 770 - protein, 253 aa, synthetic construct
  REGION 1..253: note = UROKINASE-TYPE PLASMINOGEN ACTIVATOR (u-PA) protease domain V38D/L97bR/H99L/C122S/E175D/R217T/K224S
IIGGEFTTIENQPWFAAIYRRHRGGSDTYVCGGSLISPCWVISATHCFIDYPKKEDYIVYLGRSRLNSNTQGEMKFEVENLILHKDYSADTRALHNDIALLKIRSKEGRCAQPSRTIQTISLPSMYNDPQFGTSCEITGFGKENSTDYLYPEQLKMTVVKLISHRECQQPHYYGSDVTTKMLCAADPQWKTDSCQGDSGGPLVCSLQGRMTLTGIVSWGTGCALKDSPGVYTRVSHFLPWIRSHTKEENGLAL

SEQ ID NO: 771 - protein, 253 aa, synthetic construct
  REGION 1..253: note = UROKINASE-TYPE PLASMINOGEN ACTIVATOR (u-PA) protease domain V38D/L97bV/H99L/C122S/K224A
IIGGEFTTIENQPWFAAIYRRHRGGSDTYVCGGSLISPCWVISATHCFIDYPKKEDYIVYLGRSRLNSNTQGEMKFEVENLILHKDYSADTVALHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDAPGVYTRVSHFLPWIRSHTKEENGLAL

SEQ ID NO: 772 - protein, 253 aa, synthetic construct
  REGION 1..253: note = UROKINASE-TYPE PLASMINOGEN ACTIVATOR (u-PA) protease domain V38D/L97bR/H99V/C122S/E175D/R217E/K224S
IIGGEFTTIENQPWFAAIYRRHRGGSDTYVCGGSLISPCWVISATHCFIDYPKKEDYIVYLGRSRLNSNTQGEMKFEVENLILHKDYSADTRAVHNDIALLKIRSKEGRCAQPSRTIQTISLPSMYNDPQFGTSCEITGFGKENSTDYLYPEQLKMTVVKLISHRECQQPHYYGSDVTTKMLCAADPQWKTDSCQGDSGGPLVCSLQGRMTLTGIVSWGEGCALKDSPGVYTRVSHFLPWIRSHTKEENGLAL

SEQ ID NO: 773 - protein, 253 aa, synthetic construct
  REGION 1..253: note = UROKINASE-TYPE PLASMINOGEN ACTIVATOR (u-PA) protease domain V38D/L97bG/H99Q/C122S/R217Q
IIGGEFTTIENQPWFAAIYRRHRGGSDTYVCGGSLISPCWVISATHCFIDYPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGQGCALKDKPGVYTRVSHFLPWIRSHTKEENGLAL

SEQ ID NO: 774 - protein, 253 aa, synthetic construct
  REGION 1..253: note = UROKINASE-TYPE PLASMINOGEN ACTIVATOR (u-PA) protease domain F30H/V38D/L97bA/H99Q/C122S/Y151L/M157T/Q192H
IIGGEFTTIENQPWHAAIYRRHRGGSDTYVCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLLPEQLKTTVVKLISHRECQQPHYYGSEVTTKMLCAADPQWKTDSCHGDSGGPLVCSLQGRMTLTGIVSWGRGCALKDKPGVYTRVSHFLPWIRSHTKEENGLAL

SEQ ID NO: 775 - protein, 253 aa, synthetic construct
  REGION 1..253: note = UROKINASE-TYPE PLASMINOGEN ACTIVATOR (u-PA) protease domain F30Y/V38D/Y40H/V41K/L97bA/H99Q/C122S/Y151K/M157R/Q 192E
IIGGEFTTIENQPWYAAIYRRHRGGSDTHKCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLKPEQLKRTVVKLISHRECQQPHYYGSEVTTKMLCAADPQWKTDSCEGDSGGPLVCSLQGRMTLTGIVSWGRGCALKDKPGVYTRVSHFLPWIRSHTKEENGLAL

SEQ ID NO: 776 - protein, 253 aa, synthetic construct
  REGION 1..253: note = UROKINASE-TYPE PLASMINOGEN ACTIVATOR (u-PA) protease domain F30Y/V38D/Y40H/V41K/L97bA/H99Q/C122S/Y151K/M157S/Q 192E
IIGGEFTTIENQPWYAAIYRRHRGGSDTHKCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLKPEQLKSTVVKLISHRECQQPHYYGSEVTTKMLCAADPQWKTDSCEGDSGGPLVCSLQGRMTLTGIVSWGRGCALKDKPGVYTRVSHFLPWIRSHTKEENGLAL

SEQ ID NO: 777 - protein, 253 aa, synthetic construct
  REGION 1..253: note = UROKINASE-TYPE PLASMINOGEN ACTIVATOR (u-PA) protease domain F30Y/V38D/Y40H/V41K/L97bA/H99Q/C122S/Y151K/Q192E
IIGGEFTTIENQPWYAAIYRRHRGGSDTHKCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLKPEQLKMTVVKLISHRECQQPHYYGSEVTTKMLCAADPQWKTDSCEGDSGGPLVCSLQGRMTLTGIVSWGRGCALKDKPGVYTRVSHFLPWIRSHTKEENGLAL

SEQ ID NO: 778 - protein, 253 aa, synthetic construct
  REGION 1..253: note = UROKINASE-TYPE PLASMINOGEN ACTIVATOR (u-PA) protease domain F30M/V38D/Y40F/V41R/L97bA/H99Q/C122S/Y151G/Q192T
IIGGEFTTIENQPWMAAIYRRHRGGSDTFRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLGPEQLKMTVVKLISHRECQQPHYYGSEVTTKMLCAADPQWKTDSCTGDSGGPLVCSLQGRMTLTGIVSWGRGCALKDKPGVYTRVSHFLPWIRSHTKEENGLAL

SEQ ID NO: 779 - protein, 253 aa, synthetic construct
  REGION 1..253: note = UROKINASE-TYPE PLASMINOGEN ACTIVATOR (u-PA) protease domain F30H/V38D/V41R/L97bA/H99Q/C122S/Y151M/M157R/Q192T
IIGGEFTTIENQPWHAAIYRRHRGGSDTYRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLMPEQLKRTVVKLISHRECQQPHYYGSEVTTKMLCAADPQWKTDSCTGDSGGPLVCSLQGRMTLTGIVSWGRGCALKDKPGVYTRVSHFLPWIRSHTKEENGLAL

SEQ ID NO: 780 - protein, 253 aa, synthetic construct
  REGION 1..253: note = UROKINASE-TYPE PLASMINOGEN ACTIVATOR (u-PA) protease domain F30H/V38D/Y40P/V41K/L97bA/H99Q/C122S/Y151H/M157E/Q 192A
IIGGEFTTIENQPWHAAIYRRHRGGSDTPKCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLHPEQLKETVVKLISHRECQQPHYYGSEVTTKMLCAADPQWKTDSCAGDSGGPLVCSLQGRMTLTGIVSWGRGCALKDKPGVYTRVSHFLPWIRSHTKEENGLAL

SEQ ID NO: 781 - protein, 253 aa, synthetic construct
  REGION 1..253: note = UROKINASE-TYPE PLASMINOGEN ACTIVATOR (u-PA) protease domain R37aH/V38E/T39S/D60aR/Y60bG/T97aE/L97bA/H99Q/C122S /Y149T/Y151S
IIGGEFTTIENQPWFAAIYRRHHGGSESYVCGGSLISPCWVISATHCFIRGPKKEDYIVYLGRSRLNSNTQGEMKFEVENLILHKDYSADEAAQHNDIALLKIRSKEGRCAQPSRTIQTISLPSMYNDPQFGTSCEITGFGKENSTDTLSPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 782 - protein, 253 aa, synthetic construct
  REGION 1..253: note = UROKINASE-TYPE PLASMINOGEN ACTIVATOR (u-PA) protease domain R37aH/V38E/T39A/V41R/D60aG/Y60bG/T97aI/L97bA/H99Q/ C122S/Y149V/Y151F/Q192R
IIGGEFTTIENQPWFAAIYRRHHGGSEAYRCGGSLISPCWVISATHCFIGGPKKEDYIVYLGRSRLNSNTQGEMKFEVENLILHKDYSADIAAQHNDIALLKIRSKEGRCAQPSRTIQTISLPSMYNDPQFGTSCEITGFGKENSTDVLFPEQLKMTVVKLISHRECQQPHYYGSEVTTKMLCAADPQWKTDSCRGDSGGPLVCSLQGRMTLTGIVSWGRGCALKDKPGVYTRVSHFLPWIRSHTKEENGLAL

SEQ ID NO: 783 - protein, 253 aa, synthetic construct
  REGION 1..253: note = UROKINASE-TYPE PLASMINOGEN ACTIVATOR (u-PA) protease domain R37aH/V38E/T39H/V41R/D60aT/Y60bT/T97aI/L97bA/H99Q/ C122S/Y149M/Y151N/Q192T
IIGGEFTTIENQPWFAAIYRRHHGGSEHYRCGGSLISPCWVISATHCFITTPKKEDYIVYLGRSRLNSNTQGEMKFEVENLILHKDYSADIAAQHNDIALLKIRSKEGRCAQPSRTIQTISLPSMYNDPQFGTSCEITGFGKENSTDMLNPEQLKMTVVKLISHRECQQPHYYGSEVTTKMLCAADPQWKTDSCTGDSGGPLVCSLQGRMTLTGIVSWGRGCALKDKPGVYTRVSHFLPWIRSHTKEENGLAL

SEQ ID NO: 784 - protein, 253 aa, synthetic construct
  REGION 1..253: note = UROKINASE-TYPE PLASMINOGEN ACTIVATOR (u-PA) protease domain R37aH/V38E/T39G/V41A/D60aG/Y60bE/T97aE/L97bA/H99Q/ C122S/Y149R/Y151K/Q192T
IIGGEFTTIENQPWFAAIYRRHHGGSEGYACGGSLISPCWVISATHCFIGEPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLKPEQLKMTVVKLISHRECQQPHYYGSEVTTKMLCAADPQWKTDSCTGDSGGPLVCSLQGRMTLTGIVSWGRGCALKDKPGVYTRVSHFLPWIRSHTKEENGLAL

SEQ ID NO: 785 - protein, 253 aa, synthetic construct
  REGION 1..253: note = UROKINASE-TYPE PLASMINOGEN ACTIVATOR (u-PA) protease domain V38E/T39D/V41A/D60aA/Y60bR/T97aE/L97bA/H99Q/C122S/ Y149W/Y151K/Q192T
IIGGEFTTIENQPWFAAIYRRHRGGSEDYACGGSLISPCWVISATHCFIARPKKEDYIVYLGRSRLNSNTQGEMKFEVENLILHKDYSADEAAQHNDIALLKIRSKEGRCAQPSRTIQTISLPSMYNDPQFGTSCEITGFGKENSTDWLKPEQLKMTVVKLISHRECQQPHYYGSEVTTKMLCAADPQWKTDSCTGDSGGPLVCSLQGRMTLTGIVSWGRGCALKDKPGVYTRVSHFLPWIRSHTKEENGLAL

SEQ ID NO: 786 - protein, 253 aa, synthetic construct
  REGION 1..253: note = UROKINASE-TYPE PLASMINOGEN ACTIVATOR (u-PA) protease domain V38E/T39A/V41R/D60aH/Y60bH/T97aI/L97bA/H99Q/C122S/ Y149M/Y151N/Q192T
IIGGEFTTIENQPWFAAIYRRHRGGSEAYRCGGSLISPCWVISATHCFIHHPKKEDYIVYLGRSRLNSNTQGEMKFEVENLILHKDYSADIAAQHNDIALLKIRSKEGRCAQPSRTIQTISLPSMYNDPQFGTSCEITGFGKENSTDMLNPEQLKMTVVKLISHRECQQPHYYGSEVTTKMLCAADPQWKTDSCTGDSGGPLVCSLQGRMTLTGIVSWGRGCALKDKPGVYTRVSHFLPWIRSHTKEENGLAL

SEQ ID NO: 787 - protein, 253 aa, synthetic construct
  REGION 1..253: note = UROKINASE-TYPE PLASMINOGEN ACTIVATOR (u-PA) protease domain V38E/T39F/V41R/Y60bN/T97aE/L97bA/H99Q/C122S/Y149A/ Y151G/Q192T
IIGGEFTTIENQPWFAAIYRRHRGGSEFYRCGGSLISPCWVISATHCFIDNPKKEDYIVYLGRSRLNSNTQGEMKFEVENLILHKDYSADEAAQHNDIALLKIRSKEGRCAQPSRTIQTISLPSMYNDPQFGTSCEITGFGKENSTDALGPEQLKMTVVKLISHRECQQPHYYGSEVTTKMLCAADPQWKTDSCTGDSGGPLVCSLQGRMTLTGIVSWGRGCALKDKPGVYTRVSHFLPWIRSHTKEENGLAL

SEQ ID NO: 788 - protein, 253 aa, synthetic construct
  REGION 1..253: note = UROKINASE-TYPE PLASMINOGEN ACTIVATOR (u-PA) protease domain V38E/T39D/V41A/D60aS/Y60bR/T97aE/L97bA/H99Q/C122S/ Y149W/Y151K/Q192T
IIGGEFTTIENQPWFAAIYRRHRGGSEDYACGGSLISPCWVISATHCFISRPKKEDYIVYLGRSRLNSNTQGEMKFEVENLILHKDYSADEAAQHNDIALLKIRSKEGRCAQPSRTIQTISLPSMYNDPQFGTSCEITGFGKENSTDWLKPEQLKMTVVKLISHRECQQPHYYGSEVTTKMLCAADPQWKTDSCTGDSGGPLVCSLQGRMTLTGIVSWGRGCALKDKPGVYTRVSHFLPWIRSHTKEENGLAL

SEQ ID NO: 789 - protein, 253 aa, synthetic construct
  REGION 1..253: note = UROKINASE-TYPE PLASMINOGEN ACTIVATOR (u-PA) protease domain R37aH/V38E/V41A/Y60bS/T97aE/L97bA/H99Q/C122S/Y149A /Y151M/Q192T
IIGGEFTTIENQPWFAAIYRRHHGGSETYACGGSLISPCWVISATHCFIDSPKKEDYIVYLGRSRLNSNTQGEMKFEVENLILHKDYSADEAAQHNDIALLKIRSKEGRCAQPSRTIQTISLPSMYNDPQFGTSCEITGFGKENSTDALMPEQLKMTVVKLISHRECQQPHYYGSEVTTKMLCAADPQWKTDSCTGDSGGPLVCSLQGRMTLTGIVSWGRGCALKDKPGVYTRVSHFLPWIRSHTKEENGLAL

SEQ ID NO: 790 - protein, 253 aa, synthetic construct
  REGION 1..253: note = UROKINASE-TYPE PLASMINOGEN ACTIVATOR (u-PA) protease domain R37aH/V38E/T39S/V41A/D60aG/Y60bE/T97aE/L97bA/H99Q/ C122S/Y149S/Y151H
IIGGEFTTIENQPWFAAIYRRHHGGSESYACGGSLISPCWVISATHCFIGEPKKEDYIVYLGRSRLNSNTQGEMKFEVENLILHKDYSADEAAQHNDIALLKIRSKEGRCAQPSRTIQTISLPSMYNDPQFGTSCEITGFGKENSTDSLHPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 791 - protein, 253 aa, synthetic construct
  REGION 1..253: note = UROKINASE-TYPE PLASMINOGEN ACTIVATOR (u-PA) protease domain R37aP/V38E/T39G/V41R/Y60bR/T97aE/L97bA/H99Q/C122S/ Y149T/Y151P/Q192T
IIGGEFTTIENQPWFAAIYRRHPGGSEGYRCGGSLISPCWVISATHCFIDRPKKEDYIVYLGRSRLNSNTQGEMKFEVENLILHKDYSADEAAQHNDIALLKIRSKEGRCAQPSRTIQTISLPSMYNDPQFGTSCEITGFGKENSTDTLPPEQLKMTVVKLISHRECQQPHYYGSEVTTKMLCAADPQWKTDSCTGDSGGPLVCSLQGRMTLTGIVSWGRGCALKDKPGVYTRVSHFLPWIRSHTKEENGLAL

SEQ ID NO: 792 - protein, 253 aa, synthetic construct
  REGION 1..253: note = UROKINASE-TYPE PLASMINOGEN ACTIVATOR (u-PA) protease domain R35Q/H37Y/R37aP/V38E/T39Y/V41R/D60aQ/Y60bP/T97aI/L 97bA/H99Q/C122S/Y149R
IIGGEFTTIENQPWFAAIYQRYPGGSEYYRCGGSLISPCWVISATHCFIQPPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 793 - protein, 253 aa, synthetic construct
  REGION 1..253: note = UROKINASE-TYPE PLASMINOGEN ACTIVATOR (u-PA) protease domain R35N/H37S/R37aE/V38E/T39F/V41R/D60aP/Y60bE/T97aI/L 97bA/H99Q/C122S/Y149R
IIGGEFTTIENQPWFAAIYNRSEGGSEFYRCGGSLISPCWVISATHCFIPEPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 794 - protein, 253 aa, synthetic construct
  REGION 1..253: note = UROKINASE-TYPE PLASMINOGEN ACTIVATOR (u-PA) protease domain R35H/H37P/R37aG/V38E/T39F/V41R/D60aP/Y60bE/T97aI/L 97bA/H99Q/C122S/Y149R
IIGGEFTTIENQPWFAAIYHRPGGGSEFYRCGGSLISPCWVISATHCFIPEPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 795 - protein, 253 aa, synthetic construct
  REGION 1..253: note = UROKINASE-TYPE PLASMINOGEN ACTIVATOR (u-PA) protease domain R35Q/H37G/R37aD/V38E/T39Y/V41R/D60aP/Y60bA/T97aI/L 97bA/H99Q/C122S/Y149R
IIGGEFTTIENQPWFAAIYQRGDGGSEYYRCGGSLISPCWVISATHCFIPAPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 796 - protein, 253 aa, synthetic construct
  REGION 1..253: note = UROKINASE-TYPE PLASMINOGEN ACTIVATOR (u-PA) protease domain R35L/H37D/R37aN/V38E/T39Y/V41R/D60aP/T97aI/L97bA/H 99Q/C122S/Y149R
IIGGEFTTIENQPWFAAIYLRDNGGSEYYRCGGSLISPCWVISATHCFIPYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 797 - protein, 253 aa, synthetic construct
  REGION 1..253: note = UROKINASE-TYPE PLASMINOGEN ACTIVATOR (u-PA) protease domain R35N/H37T/R37aY/V38E/T39Y/V41R/D60aP/Y60bE/T97aI/L 97bA/H99Q/C122S/Y149R
IIGGEFTTIENQPWFAAIYNRTYGGSEYYRCGGSLISPCWVISATHCFIPEPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 798 - protein, 253 aa, synthetic construct
  REGION 1..253: note = UROKINASE-TYPE PLASMINOGEN ACTIVATOR (u-PA) protease domain R35Q/H37D/R37aK/V38E/T39F/V41R/D60aP/Y60bS/T97aI/L 97bA/H99Q/C122S/Y149R
IIGGEFTTIENQPWFAAIYQRDKGGSEFYRCGGSLISPCWVISATHCFIPSPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 799 - protein, 253 aa, synthetic construct
  REGION 1..253: note = UROKINASE-TYPE PLASMINOGEN ACTIVATOR (u-PA) protease domain R35Q/H37Y/R37aS/V38E/T39Y/V41R/D60aP/Y60bE/T97aI/L 97bA/H99Q/C122S/Y149R
IIGGEFTTIENQPWFAAIYQRYSGGSEYYRCGGSLISPCWVISATHCFIPEPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 800 - protein, 253 aa, synthetic construct
  REGION 1..253: note = UROKINASE-TYPE PLASMINOGEN ACTIVATOR (u-PA) protease domain R35Q/H37Y/R37aP/V38E/T39Y/V41R/D60aN/Y60bN/T97aI/L 97bA/H99Q/C122S/Y149R
IIGGEFTTIENQPWFAAIYQRYPGGSEYYRCGGSLISPCWVISATHCFINNPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 801 - protein, 253 aa, synthetic construct
  REGION 1..253: note = UROKINASE-TYPE PLASMINOGEN ACTIVATOR (u-PA) protease domain R35Q/H37S/R37aP/V38E/T39Y/V41R/D60aP/Y60bE/T97aI/L 97bA/H99Q/C122S/Y149R
IIGGEFTTIENQPWFAAIYQRSPGGSEYYRCGGSLISPCWVISATHCFIPEPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 802 - protein, 253 aa, synthetic construct
  REGION 1..253: note = UROKINASE-TYPE PLASMINOGEN ACTIVATOR (u-PA) protease domain R35Y/H37D/V38E/T39W/V41R/D60aP/Y60bE/T97aI/L97bA/H 99Q/C122S/Y149R
IIGGEFTTIENQPWFAAIYYRDRGGSEWYRCGGSLISPCWVISATHCFIPEPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 803 - protein, 253 aa, synthetic construct
  REGION 1..253: note = UROKINASE-TYPE PLASMINOGEN ACTIVATOR (u-PA) protease domain V38E/T39W/V41T/Y60bK/T97aE/L97bA/H99Q/C122S/Y149I/ Y151G/Q192T
IIGGEFTTIENQPWFAAIYRRHRGGSEWYTCGGSLISPCWVISATHCFIDKPKKEDYIVYLGRSRLNSNTQGEMKFEVENLILHKDYSADEAAQHNDIALLKIRSKEGRCAQPSRTIQTISLPSMYNDPQFGTSCEITGFGKENSTDILGPEQLKMTVVKLISHRECQQPHYYGSEVTTKMLCAADPQWKTDSCTGDSGGPLVCSLQGRMTLTGIVSWGRGCALKDKPGVYTRVSHFLPWIRSHTKEENGLAL

SEQ ID NO: 804 - protein, 253 aa, synthetic construct
  REGION 1..253: note = UROKINASE-TYPE PLASMINOGEN ACTIVATOR (u-PA) protease domain V38E/T39W/V41T/D60aP/Y60bQ/T97aE/L97bA/H99Q/C122S/ Y149V/Y151G/Q192T
IIGGEFTTIENQPWFAAIYRRHRGGSEWYTCGGSLISPCWVISATHCFIPQPKKEDYIVYLGRSRLNSNTQGEMKFEVENLILHKDYSADEAAQHNDIALLKIRSKEGRCAQPSRTIQTISLPSMYNDPQFGTSCEITGFGKENSTDVLGPEQLKMTVVKLISHRECQQPHYYGSEVTTKMLCAADPQWKTDSCTGDSGGPLVCSLQGRMTLTGIVSWGRGCALKDKPGVYTRVSHFLPWIRSHTKEENGLAL

SEQ ID NO: 805 - protein, 253 aa, synthetic construct
  REGION 1..253: note = UROKINASE-TYPE PLASMINOGEN ACTIVATOR (u-PA) protease domain V38E/T39W/V41T/D60aP/Y60bW/T97aI/L97bA/H99Q/C122S/ Y149L/Y151G/Q192T
IIGGEFTTIENQPWFAAIYRRHRGGSEWYTCGGSLISPCWVISATHCFIPWPKKEDYIVYLGRSRLNSNTQGEMKFEVENLILHKDYSADIAAQHNDIALLKIRSKEGRCAQPSRTIQTISLPSMYNDPQFGTSCEITGFGKENSTDLLGPEQLKMTVVKLISHRECQQPHYYGSEVTTKMLCAADPQWKTDSCTGDSGGPLVCSLQGRMTLTGIVSWGRGCALKDKPGVYTRVSHFLPWIRSHTKEENGLAL

SEQ ID NO: 806 - protein, 253 aa, synthetic construct
  REGION 1..253: note = UROKINASE-TYPE PLASMINOGEN ACTIVATOR (u-PA) protease domain V38E/T39W/V41Q/Y60bE/T97aE/L97bA/H99Q/C122S/Y149I/ Y151G/Q192T
IIGGEFTTIENQPWFAAIYRRHRGGSEWYQCGGSLISPCWVISATHCFIDEPKKEDYIVYLGRSRLNSNTQGEMKFEVENLILHKDYSADEAAQHNDIALLKIRSKEGRCAQPSRTIQTISLPSMYNDPQFGTSCEITGFGKENSTDILGPEQLKMTVVKLISHRECQQPHYYGSEVTTKMLCAADPQWKTDSCTGDSGGPLVCSLQGRMTLTGIVSWGRGCALKDKPGVYTRVSHFLPWIRSHTKEENGLAL

SEQ ID NO: 807 - protein, 253 aa, synthetic construct
  REGION 1..253: note = UROKINASE-TYPE PLASMINOGEN ACTIVATOR (u-PA) protease domain V38E/T39L/V41R/D60aP/Y60bD/T97aI/L97bA/H99Q/C122S/ Y149V/Y151L/Q192T
IIGGEFTTIENQPWFAAIYRRHRGGSELYRCGGSLISPCWVISATHCFIPDPKKEDYIVYLGRSRLNSNTQGEMKFEVENLILHKDYSADIAAQHNDIALLKIRSKEGRCAQPSRTIQTISLPSMYNDPQFGTSCEITGFGKENSTDVLLPEQLKMTVVKLISHRECQQPHYYGSEVTTKMLCAADPQWKTDSCTGDSGGPLVCSLQGRMTLTGIVSWGRGCALKDKPGVYTRVSHFLPWIRSHTKEENGLAL

SEQ ID NO: 808 - protein, 253 aa, synthetic construct
  REGION 1..253: note = UROKINASE-TYPE PLASMINOGEN ACTIVATOR (u-PA) protease domain V38D/L97bR/H99M/C122S/E175D/R217E
IIGGEFTTIENQPWFAAIYRRHRGGSDTYVCGGSLISPCWVISATHCFIDYPKKEDYIVYLGRSRLNSNTQGEMKFEVENLILHKDYSADTRAMHNDIALLKIRSKEGRCAQPSRTIQTISLPSMYNDPQFGTSCEITGFGKENSTDYLYPEQLKMTVVKLISHRECQQPHYYGSDVTTKMLCAADPQWKTDSCQGDSGGPLVCSLQGRMTLTGIVSWGEGCALKDKPGVYTRVSHFLPWIRSHTKEENGLAL

SEQ ID NO: 809 - protein, 253 aa, synthetic construct
  REGION 1..253: note = UROKINASE-TYPE PLASMINOGEN ACTIVATOR (u-PA) protease domain V38D/L97bR/H99M/C122S/E175D/R217E/K224R
IIGGEFTTIENQPWFAAIYRRHRGGSDTYVCGGSLISPCWVISATHCFIDYPKKEDYIVYLGRSRLNSNTQGEMKFEVENLILHKDYSADTRAMHNDIALLKIRSKEGRCAQPSRTIQTISLPSMYNDPQFGTSCEITGFGKENSTDYLYPEQLKMTVVKLISHRECQQPHYYGSDVTTKMLCAADPQWKTDSCQGDSGGPLVCSLQGRMTLTGIVSWGEGCALKDRPGVYTRVSHFLPWIRSHTKEENGLAL

SEQ ID NO: 810 - protein, 253 aa, synthetic construct
  REGION 1..253: note = UROKINASE-TYPE PLASMINOGEN ACTIVATOR (u-PA) protease domain V38D/L97bR/C122S/E175D/R217E/K224R
IIGGEFTTIENQPWFAAIYRRHRGGSDTYVCGGSLISPCWVISATHCFIDYPKKEDYIVYLGRSRLNSNTQGEMKFEVENLILHKDYSADTRAHHNDIALLKIRSKEGRCAQPSRTIQTISLPSMYNDPQFGTSCEITGFGKENSTDYLYPEQLKMTVVKLISHRECQQPHYYGSDVTTKMLCAADPQWKTDSCQGDSGGPLVCSLQGRMTLTGIVSWGEGCALKDRPGVYTRVSHFLPWIRSHTKEENGLAL

SEQ ID NO: 811 - protein, 253 aa, synthetic construct
  REGION 1..253: note = UROKINASE-TYPE PLASMINOGEN ACTIVATOR (u-PA) protease domain V38D/L97bR/H99L/C122S/E175D/R217E/K224R
IIGGEFTTIENQPWFAAIYRRHRGGSDTYVCGGSLISPCWVISATHCFIDYPKKEDYIVYLGRSRLNSNTQGEMKFEVENLILHKDYSADTRALHNDIALLKIRSKEGRCAQPSRTIQTISLPSMYNDPQFGTSCEITGFGKENSTDYLYPEQLKMTVVKLISHRECQQPHYYGSDVTTKMLCAADPQWKTDSCQGDSGGPLVCSLQGRMTLTGIVSWGEGCALKDRPGVYTRVSHFLPWIRSHTKEENGLAL

SEQ ID NO: 812 - protein, 253 aa, synthetic construct
  REGION 1..253: note = UROKINASE-TYPE PLASMINOGEN ACTIVATOR (u-PA) protease domain V38D/L97bT/H99L/C122S/E175D/R217K
IIGGEFTTIENQPWFAAIYRRHRGGSDTYVCGGSLISPCWVISATHCFIDYPKKEDYIVYLGRSRLNSNTQGEMKFEVENLILHKDYSADTTALHNDIALLKIRSKEGRCAQPSRTIQTISLPSMYNDPQFGTSCEITGFGKENSTDYLYPEQLKMTVVKLISHRECQQPHYYGSDVTTKMLCAADPQWKTDSCQGDSGGPLVCSLQGRMTLTGIVSWGKGCALKDKPGVYTRVSHFLPWIRSHTKEENGLAL

SEQ ID NO: 813 - protein, 253 aa, synthetic construct
  REGION 1..253: note = UROKINASE-TYPE PLASMINOGEN ACTIVATOR (u-PA) protease domain V38D/L97bR/H99L/C122S/E175D/K224A
IIGGEFTTIENQPWFAAIYRRHRGGSDTYVCGGSLISPCWVISATHCFIDYPKKEDYIVYLGRSRLNSNTQGEMKFEVENLILHKDYSADTRALHNDIALLKIRSKEGRCAQPSRTIQTISLPSMYNDPQFGTSCEITGFGKENSTDYLYPEQLKMTVVKLISHRECQQPHYYGSDVTTKMLCAADPQWKTDSCQGDSGGPLVCSLQGRMTLTGIVSWGRGCALKDAPGVYTRVSHFLPWIRSHTKEENGLAL

SEQ ID NO: 814 - protein, 253 aa, synthetic construct
  REGION 1..253: note = UROKINASE-TYPE PLASMINOGEN ACTIVATOR (u-PA) protease domain V38D/L97bM/H99S/C122S/K224S
IIGGEFTTIENQPWFAAIYRRHRGGSDTYVCGGSLISPCWVISATHCFIDYPKKEDYIVYLGRSRLNSNTQGEMKFEVENLILHKDYSADTMASHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDSPGVYTRVSHFLPWIRSHTKEENGLAL

SEQ ID NO: 815 - protein, 253 aa, synthetic construct
  REGION 1..253: note = UROKINASE-TYPE PLASMINOGEN ACTIVATOR (u-PA) protease domain V38D/L97bK/H99L/C122S/E175D/K224A
IIGGEFTTIENQPWFAAIYRRHRGGSDTYVCGGSLISPCWVISATHCFIDYPKKEDYIVYLGRSRLNSNTQGEMKFEVENLILHKDYSADTKALHNDIALLKIRSKEGRCAQPSRTIQTISLPSMYNDPQFGTSCEITGFGKENSTDYLYPEQLKMTVVKLISHRECQQPHYYGSDVTTKMLCAADPQWKTDSCQGDSGGPLVCSLQGRMTLTGIVSWGRGCALKDAPGVYTRVSHFLPWIRSHTKEENGLAL

SEQ ID NO: 816 - protein, 253 aa, synthetic construct
  REGION 1..253: note = UROKINASE-TYPE PLASMINOGEN ACTIVATOR (u-PA) protease domain V38D/L97bR/H99V/C122S/E175D/R217E/K224R
IIGGEFTTIENQPWFAAIYRRHRGGSDTYVCGGSLISPCWVISATHCFIDYPKKEDYIVYLGRSRLNSNTQGEMKFEVENLILHKDYSADTRAVHNDIALLKIRSKEGRCAQPSRTIQTISLPSMYNDPQFGTSCEITGFGKENSTDYLYPEQLKMTVVKLISHRECQQPHYYGSDVTTKMLCAADPQWKTDSCQGDSGGPLVCSLQGRMTLTGIVSWGEGCALKDRPGVYTRVSHFLPWIRSHTKEENGLAL

SEQ ID NO: 817 - protein, 253 aa, synthetic construct
  REGION 1..253: note = UROKINASE-TYPE PLASMINOGEN ACTIVATOR (u-PA) protease domain V38D/L97bT/H99E/C122S/E175D/K224S
IIGGEFTTIENQPWFAAIYRRHRGGSDTYVCGGSLISPCWVISATHCFIDYPKKEDYIVYLGRSRLNSNTQGEMKFEVENLILHKDYSADTTAEHNDIALLKIRSKEGRCAQPSRTIQTISLPSMYNDPQFGTSCEITGFGKENSTDYLYPEQLKMTVVKLISHRECQQPHYYGSDVTTKMLCAADPQWKTDSCQGDSGGPLVCSLQGRMTLTGIVSWGRGCALKDSPGVYTRVSHFLPWIRSHTKEENGLAL

SEQ ID NO: 818 - protein, 253 aa, synthetic construct
  REGION 1..253: note = UROKINASE-TYPE PLASMINOGEN ACTIVATOR (u-PA) protease domain V38D/V41R/Y60bK/T97aS/L97bR/H99E/C122S/Y151L/E175D /Q192T/R217E/K224R
IIGGEFTTIENQPWFAAIYRRHRGGSDTYRCGGSLISPCWVISATHCFIDKPKKEDYIVYLGRSRLNSNTQGEMKFEVENLILHKDYSADSRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDRPGVYTRVSHFLPWIRSHTKEENGLAL

SEQ ID NO: 819 - protein, 253 aa, synthetic construct
  REGION 1..253: note = UROKINASE-TYPE PLASMINOGEN ACTIVATOR (u-PA) protease domain V38D/V41Q/D60aK/Y60bD/T97aA/L97bR/H99E/C122S/Y151L /E175D/Q192Y/R217E/K224R
IIGGEFTTIENQPWFAAIYRRHRGGSDTYQCGGSLISPCWVISATHCFIKDPKKEDYIVYLGRSRLNSNTQGEMKFEVENLILHKDYSADARAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCYGDSGGPLVCSLQGRMTLTGIVSWGEGCALKDRPGVYTRVSHFLPWIRSHTKEENGLAL

SEQ ID NO: 820 - protein, 253 aa, synthetic construct
  REGION 1..253: note = UROKINASE-TYPE PLASMINOGEN ACTIVATOR (u-PA) protease domain V38D/V41Q/D60aP/Y60bS/T97aS/L97bR/H99E/C122S/Y151L /E175D/Q192Y/R217E/K224R
IIGGEFTTIENQPWFAAIYRRHRGGSDTYQCGGSLISPCWVISATHCFIPSPKKEDYIVYLGRSRLNSNTQGEMKFEVENLILHKDYSADSRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCYGDSGGPLVCSLQGRMTLTGIVSWGEGCALKDRPGVYTRVSHFLPWIRSHTKEENGLAL

SEQ ID NO: 821 - protein, 253 aa, synthetic construct
  REGION 1..253: note = UROKINASE-TYPE PLASMINOGEN ACTIVATOR (u-PA) protease domain V38D/V41R/Y60bR/T97aW/L97bR/H99E/C122S/E175D/R217E /K224R
IIGGEFTTIENQPWFAAIYRRHRGGSDTYRCGGSLISPCWVISATHCFIDRPKKEDYIVYLGRSRLNSNTQGEMKFEVENLILHKDYSADWRAEHNDIALLKIRSKEGRCAQPSRTIQTISLPSMYNDPQFGTSCEITGFGKENSTDYLYPEQLKMTVVKLISHRECQQPHYYGSDVTTKMLCAADPQWKTDSCQGDSGGPLVCSLQGRMTLTGIVSWGEGCALKDRPGVYTRVSHFLPWIRSHTKEENGLAL

SEQ ID NO: 822 - protein, 253 aa, synthetic construct
  REGION 1..253: note = UROKINASE-TYPE PLASMINOGEN ACTIVATOR (u-PA) protease domain V38D/V41R/Y60bS/T97aI/L97bR/H99E/C122S/Y151L/E175D /Q192F/R217E/K224R
IIGGEFTTIENQPWFAAIYRRHRGGSDTYRCGGSLISPCWVISATHCFIDSPKKEDYIVYLGRSRLNSNTQGEMKFEVENLILHKDYSADIRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCFGDSGGPLVCSLQGRMTLTGIVSWGEGCALKDRPGVYTRVSHFLPWIRSHTKEENGLAL

SEQ ID NO: 823 - protein, 253 aa, synthetic construct
  REGION 1..253: note = UROKINASE-TYPE PLASMINOGEN ACTIVATOR (u-PA) protease domain V38D/V41L/Y60bP/T97aM/L97bR/H99E/C122S/Y151L/E175D /R217E/K224R
IIGGEFTTIENQPWFAAIYRRHRGGSDTYLCGGSLISPCWVISATHCFIDPPKKEDYIVYLGRSRLNSNTQGEMKFEVENLILHKDYSADMRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCQGDSGGPLVCSLQGRMTLTGIVSWGEGCALKDRPGVYTRVSHFLPWIRSHTKEENGLAL

SEQ ID NO: 824 - protein, 253 aa, synthetic construct
  REGION 1..253: note = UROKINASE-TYPE PLASMINOGEN ACTIVATOR (u-PA) protease domain V38D/V41Q/D60aH/Y60bS/T97aW/L97bR/H99E/C122S/Y151L /E175D/R217E/K224R
IIGGEFTTIENQPWFAAIYRRHRGGSDTYQCGGSLISPCWVISATHCFIHSPKKEDYIVYLGRSRLNSNTQGEMKFEVENLILHKDYSADWRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCQGDSGGPLVCSLQGRMTLTGIVSWGEGCALKDRPGVYTRVSHFLPWIRSHTKEENGLAL

SEQ ID NO: 825 - protein, 253 aa, synthetic construct
  REGION 1..253: note = UROKINASE-TYPE PLASMINOGEN ACTIVATOR (u-PA) protease domain V38D/V41K/D60aN/Y60bN/L97bR/H99E/C122S/Y151L/E175D /Q192H/R217E/K224R
IIGGEFTTIENQPWFAAIYRRHRGGSDTYKCGGSLISPCWVISATHCFINNPKKEDYIVYLGRSRLNSNTQGEMKFEVENLILHKDYSADTRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCHGDSGGPLVCSLQGRMTLTGIVSWGEGCALKDRPGVYTRVSHFLPWIRSHTKEENGLAL

SEQ ID NO: 826 - protein, 253 aa, synthetic construct
  REGION 1..253: note = UROKINASE-TYPE PLASMINOGEN ACTIVATOR (u-PA) protease domain V38D/V41Q/Y60bR/T97aW/L97bR/H99E/C122S/Y151L/E175D /Q192T/R217E/K224R
IIGGEFTTIENQPWFAAIYRRHRGGSDTYQCGGSLISPCWVISATHCFIDRPKKEDYIVYLGRSRLNSNTQGEMKFEVENLILHKDYSADWRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDRPGVYTRVSHFLPWIRSHTKEENGLAL

SEQ ID NO: 827 - protein, 253 aa, synthetic construct
  REGION 1..253: note = UROKINASE-TYPE PLASMINOGEN ACTIVATOR (u-PA) protease domain V38D/V41L/L97bG/H99Q/C122S/Y151L/R217Q
IIGGEFTTIENQPWFAAIYRRHRGGSDTYLCGGSLISPCWVISATHCFIDYPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCQGDSGGPLVCSLQGRMTLTGIVSWGQGCALKDKPGVYTRVSHFLPWIRSHTKEENGLAL

SEQ ID NO: 828 - protein, 253 aa, synthetic construct
  REGION 1..253: note = UROKINASE-TYPE PLASMINOGEN ACTIVATOR (u-PA) protease domain V38D/V41Q/L97bG/H99Q/C122S/Y151L/Q192S/R217A
IIGGEFTTIENQPWFAAIYRRHRGGSDTYQCGGSLISPCWVISATHCFIDYPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCSGDSGGPLVCSLQGRMTLTGIVSWGAGCALKDKPGVYTRVSHFLPWIRSHTKEENGLAL

SEQ ID NO: 829 - protein, 253 aa, synthetic construct
  REGION 1..253: note = UROKINASE-TYPE PLASMINOGEN ACTIVATOR (u-PA) protease domain R37aS/V38D/V41Q/L97bG/H99Q/C122S/Y151L/R217T
IIGGEFTTIENQPWFAAIYRRHSGGSDTYQCGGSLISPCWVISATHCFIDYPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCQGDSGGPLVCSLQGRMTLTGIVSWGTGCALKDKPGVYTRVSHFLPWIRSHTKEENGLAL

SEQ ID NO: 830 - protein, 253 aa, synthetic construct
  REGION 1..253: note = UROKINASE-TYPE PLASMINOGEN ACTIVATOR (u-PA) protease domain V38D/V41R/L97bG/H99Q/C122S/Y151L/R217A
IIGGEFTTIENQPWFAAIYRRHRGGSDTYRCGGSLISPCWVISATHCFIDYPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCQGDSGGPLVCSLQGRMTLTGIVSWGAGCALKDKPGVYTRVSHFLPWIRSHTKEENGLAL

SEQ ID NO: 831 - protein, 253 aa, synthetic construct
  REGION 1..253: note = UROKINASE-TYPE PLASMINOGEN ACTIVATOR (u-PA) protease domain V38D/V41R/L97bG/H99Q/C122S/Y151L/R217E
IIGGEFTTIENQPWFAAIYRRHRGGSDTYRCGGSLISPCWVISATHCFIDYPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCQGDSGGPLVCSLQGRMTLTGIVSWGEGCALKDKPGVYTRVSHFLPWIRSHTKEENGLAL

SEQ ID NO: 832 - protein, 253 aa, synthetic construct
  REGION 1..253: note = UROKINASE-TYPE PLASMINOGEN ACTIVATOR (u-PA) protease domain R35Q/V38D/V41R/T97aS/L97bA/H99Q/C122S/Y151L
IIGGEFTTIENQPWFAAIYQRHRGGSDTYRCGGSLISPCWVISATHCFIDYPKKEDYIVYLGRSRLNSNTQGEMKFEVENLILHKDYSADSAAQHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 833 - protein, 253 aa, synthetic construct
  REGION 1..253: note = UROKINASE-TYPE PLASMINOGEN ACTIVATOR (u-PA) protease domain V38D/V41Q/L97bG/H99Q/C122S/Y151L/R217T
IIGGEFTTIENQPWFAAIYRRHRGGSDTYQCGGSLISPCWVISATHCFIDYPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCQGDSGGPLVCSLQGRMTLTGIVSWGTGCALKDKPGVYTRVSHFLPWIRSHTKEENGLAL

SEQ ID NO: 834 - protein, 253 aa, synthetic construct
  REGION 1..253: note = UROKINASE-TYPE PLASMINOGEN ACTIVATOR (u-PA) protease domain R35Q/V38D/V41R/L97bG/H99Q/C122S/Y151L
IIGGEFTTIENQPWFAAIYQRHRGGSDTYRCGGSLISPCWVISATHCFIDYPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 835 - protein, 253 aa, synthetic construct
  REGION 1..253: note = UROKINASE-TYPE PLASMINOGEN ACTIVATOR (u-PA) protease domain R35S/V38D/V41R/L97bA/H99Q/C122S/Y151L
IIGGEFTTIENQPWFAAIYSRHRGGSDTYRCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 836 - protein, 253 aa, synthetic construct
  REGION 1..253: note = UROKINASE-TYPE PLASMINOGEN ACTIVATOR (u-PA) protease domain R35S/V38D/V41L/L97bG/H99Q/C122S/Y151L/R217Q
IIGGEFTTIENQPWFAAIYSRHRGGSDTYLCGGSLISPCWVISATHCFIDYPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCQGDSGGPLVCSLQGRMTLTGIVSWGQGCALKDKPGVYTRVSHFLPWIRSHTKEENGLAL

SEQ ID NO: 837 - protein, 253 aa, synthetic construct
  REGION 1..253: note = UROKINASE-TYPE PLASMINOGEN ACTIVATOR (u-PA) protease domain V38D/V41R/L97bG/H99Q/C122S/Y151L/Q192S/R217A
IIGGEFTTIENQPWFAAIYRRHRGGSDTYRCGGSLISPCWVISATHCFIDYPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCSGDSGGPLVCSLQGRMTLTGIVSWGAGCALKDKPGVYTRVSHFLPWIRSHTKEENGLAL

SEQ ID NO: 838 - protein, 253 aa, synthetic construct
  REGION 1..253: note = UROKINASE-TYPE PLASMINOGEN ACTIVATOR (u-PA) protease domain R35S/V38D/Y40Q/V41R/Y60bS/L97bG/H99Q/C122S
IIGGEFTTIENQPWFAAIYSRHRGGSDTQRCGGSLISPCWVISATHCFIDSPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 839 - protein, 253 aa, synthetic construct
  REGION 1..253: note = UROKINASE-TYPE PLASMINOGEN ACTIVATOR (u-PA) protease domain R35K/V38D/Y40H/V41R/Y60bS/L97bG/H99Q/C122S
IIGGEFTTIENQPWFAAIYKRHRGGSDTHRCGGSLISPCWVISATHCFIDSPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 840 - protein, 253 aa, synthetic construct
  REGION 1..253: note = UROKINASE-TYPE PLASMINOGEN ACTIVATOR (u-PA) protease domain R35Q/V38D/Y40L/V41L/Y60bP/L97bG/H99Q/C122S
IIGGEFTTIENQPWFAAIYQRHRGGSDTLLCGGSLISPCWVISATHCFIDPPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 841 - protein, 253 aa, synthetic construct
  REGION 1..253: note = UROKINASE-TYPE PLASMINOGEN ACTIVATOR (u-PA) protease domain R35S/V38D/Y40H/V41L/Y60bD/L97bG/H99Q/C122S
IIGGEFTTIENQPWFAAIYSRHRGGSDTHLCGGSLISPCWVISATHCFIDDPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 842 - protein, 253 aa, synthetic construct
  REGION 1..253: note = UROKINASE-TYPE PLASMINOGEN ACTIVATOR (u-PA) protease domain V38D/V41R/Y60bN/T97aL/L97bR/H99E/C122S/Y151L/E175D /Q192T/R217E/K224R
IIGGEFTTIENQPWFAAIYRRHRGGSDTYRCGGSLISPCWVISATHCFIDNPKKEDYIVYLGRSRLNSNTQGEMKFEVENLILHKDYSADLRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDRPGVYTRVSHFLPWIRSHTKEENGLAL

SEQ ID NO: 843 - protein, 253 aa, synthetic construct
  REGION 1..253: note = UROKINASE-TYPE PLASMINOGEN ACTIVATOR (u-PA) protease domain V38D/V41Q/Y60bR/T97aF/L97bR/H99Q/C122S/Y151L/E175D /Q192H/R217E/K224R
IIGGEFTTIENQPWFAAIYRRHRGGSDTYQCGGSLISPCWVISATHCFIDRPKKEDYIVYLGRSRLNSNTQGEMKFEVENLILHKDYSADFRAQHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCHGDSGGPLVCSLQGRMTLTGIVSWGEGCALKDRPGVYTRVSHFLPWIRSHTKEENGLAL

SEQ ID NO: 844 - protein, 253 aa, synthetic construct
  REGION 1..253: note = UROKINASE-TYPE PLASMINOGEN ACTIVATOR (u-PA) protease domain V38D/V41R/D60aP/Y60bD/T97aP/L97bR/H99Q/C122S/Y151L /E175D/Q192R/R217E/K224R
IIGGEFTTIENQPWFAAIYRRHRGGSDTYRCGGSLISPCWVISATHCFIPDPKKEDYIVYLGRSRLNSNTQGEMKFEVENLILHKDYSADPRAQHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCRGDSGGPLVCSLQGRMTLTGIVSWGEGCALKDRPGVYTRVSHFLPWIRSHTKEENGLAL

SEQ ID NO: 845 - protein, 253 aa, synthetic construct
  REGION 1..253: note = UROKINASE-TYPE PLASMINOGEN ACTIVATOR (u-PA) protease domain V38D/V41Q/Y60bP/T97aW/L97bR/H99Q/C122S/Y151L/E175D /Q192K/R217E/K224R
IIGGEFTTIENQPWFAAIYRRHRGGSDTYQCGGSLISPCWVISATHCFIDPPKKEDYIVYLGRSRLNSNTQGEMKFEVENLILHKDYSADWRAQHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCKGDSGGPLVCSLQGRMTLTGIVSWGEGCALKDRPGVYTRVSHFLPWIRSHTKEENGLAL

SEQ ID NO: 846 - protein, 253 aa, synthetic construct
  REGION 1..253: note = UROKINASE-TYPE PLASMINOGEN ACTIVATOR (u-PA) protease domain R37aS/V38D/V41R/Y60bT/T97aD/L97bR/H99Q/C122S/Y151L /E175D/Q192A/R217E/K224R
IIGGEFTTIENQPWFAAIYRRHSGGSDTYRCGGSLISPCWVISATHCFIDTPKKEDYIVYLGRSRLNSNTQGEMKFEVENLILHKDYSADDRAQHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCAGDSGGPLVCSLQGRMTLTGIVSWGEGCALKDRPGVYTRVSHFLPWIRSHTKEENGLAL

SEQ ID NO: 847 - protein, 253 aa, synthetic construct
  REGION 1..253: note = UROKINASE-TYPE PLASMINOGEN ACTIVATOR (u-PA) protease domain V38D/V41K/D60aE/Y60bP/T97aA/L97bR/H99L/C122S/Y151L /E175D/Q192R/R217E/K224R
IIGGEFTTIENQPWFAAIYRRHRGGSDTYKCGGSLISPCWVISATHCFIEPPKKEDYIVYLGRSRLNSNTQGEMKFEVENLILHKDYSADARALHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCRGDSGGPLVCSLQGRMTLTGIVSWGEGCALKDRPGVYTRVSHFLPWIRSHTKEENGLAL

SEQ ID NO: 848 - protein, 253 aa, synthetic construct
  REGION 1..253: note = UROKINASE-TYPE PLASMINOGEN ACTIVATOR (u-PA) protease domain R37aS/V38D/V41R/D60aS/Y60bP/L97bR/H99Q/C122S/Y151L /E175D/Q192R/R217E/K224R
IIGGEFTTIENQPWFAAIYRRHSGGSDTYRCGGSLISPCWVISATHCFISPPKKEDYIVYLGRSRLNSNTQGEMKFEVENLILHKDYSADTRAQHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCRGDSGGPLVCSLQGRMTLTGIVSWGEGCALKDRPGVYTRVSHFLPWIRSHTKEENGLAL

SEQ ID NO: 849 - protein, 253 aa, synthetic construct
  REGION 1..253: note = UROKINASE-TYPE PLASMINOGEN ACTIVATOR (u-PA) protease domain V38D/V41R/Y60bR/L97bR/H99E/C122S/Y151L/E175D/Q192T /R217E/K224R
IIGGEFTTIENQPWFAAIYRRHRGGSDTYRCGGSLISPCWVISATHCFIDRPKKEDYIVYLGRSRLNSNTQGEMKFEVENLILHKDYSADTRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDRPGVYTRVSHFLPWIRSHTKEENGLAL

SEQ ID NO: 850 - protein, 253 aa, synthetic construct
  REGION 1..253: note = UROKINASE-TYPE PLASMINOGEN ACTIVATOR (u-PA) protease domain V38D/V41R/D60aP/Y60bD/T97aW/L97bR/H99Q/C122S/Y151L /E175D/Q192A/R217E/K224R
IIGGEFTTIENQPWFAAIYRRHRGGSDTYRCGGSLISPCWVISATHCFIPDPKKEDYIVYLGRSRLNSNTQGEMKFEVENLILHKDYSADWRAQHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCAGDSGGPLVCSLQGRMTLTGIVSWGEGCALKDRPGVYTRVSHFLPWIRSHTKEENGLAL

SEQ ID NO: 851 - protein, 253 aa, synthetic construct
  REGION 1..253: note = UROKINASE-TYPE PLASMINOGEN ACTIVATOR (u-PA) protease domain V38D/V41Q/D60aN/Y60bP/L97bR/H99L/C122S/Y151L/E175D /Q192R/R217E/K224R
IIGGEFTTIENQPWFAAIYRRHRGGSDTYQCGGSLISPCWVISATHCFINPPKKEDYIVYLGRSRLNSNTQGEMKFEVENLILHKDYSADTRALHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCRGDSGGPLVCSLQGRMTLTGIVSWGEGCALKDRPGVYTRVSHFLPWIRSHTKEENGLAL

SEQ ID NO: 852 - protein, 253 aa, synthetic construct
  REGION 1..253: note = UROKINASE-TYPE PLASMINOGEN ACTIVATOR (u-PA) protease domain V38D/V41Q/D60aN/Y60bP/T97aN/L97bR/H99I/C122S/Y151L /E175D/Q192R/R217E/K224R
IIGGEFTTIENQPWFAAIYRRHRGGSDTYQCGGSLISPCWVISATHCFINPPKKEDYIVYLGRSRLNSNTQGEMKFEVENLILHKDYSADNRAIHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCRGDSGGPLVCSLQGRMTLTGIVSWGEGCALKDRPGVYTRVSHFLPWIRSHTKEENGLAL

SEQ ID NO: 853 - protein, 253 aa, synthetic construct
  REGION 1..253: note = UROKINASE-TYPE PLASMINOGEN ACTIVATOR (u-PA) protease domain V38D/V41Q/Y60bP/T97aY/L97bR/H99L/C122S/Y151L/E175D /Q192K/R217E/K224R
IIGGEFTTIENQPWFAAIYRRHRGGSDTYQCGGSLISPCWVISATHCFIDPPKKEDYIVYLGRSRLNSNTQGEMKFEVENLILHKDYSADYRALHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCKGDSGGPLVCSLQGRMTLTGIVSWGEGCALKDRPGVYTRVSHFLPWIRSHTKEENGLAL

SEQ ID NO: 854 - protein, 253 aa, synthetic construct
  REGION 1..253: note = UROKINASE-TYPE PLASMINOGEN ACTIVATOR (u-PA) protease domain V38D/V41R/Y60bR/L97bR/H99L/C122S/Y151L/E175D/Q192T /R217E/K224R
IIGGEFTTIENQPWFAAIYRRHRGGSDTYRCGGSLISPCWVISATHCFIDRPKKEDYIVYLGRSRLNSNTQGEMKFEVENLILHKDYSADTRALHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDRPGVYTRVSHFLPWIRSHTKEENGLAL

SEQ ID NO: 855 - protein, 253 aa, synthetic construct
  REGION 1..253: note = UROKINASE-TYPE PLASMINOGEN ACTIVATOR (u-PA) protease domain V38D/V41R/Y60bR/L97bR/H99L/C122S/Y151L/E175D/Q192Y /R217E/K224R
IIGGEFTTIENQPWFAAIYRRHRGGSDTYRCGGSLISPCWVISATHCFIDRPKKEDYIVYLGRSRLNSNTQGEMKFEVENLILHKDYSADTRALHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCYGDSGGPLVCSLQGRMTLTGIVSWGEGCALKDRPGVYTRVSHFLPWIRSHTKEENGLAL

SEQ ID NO: 856 - protein, 253 aa, synthetic construct
  REGION 1..253: note = UROKINASE-TYPE PLASMINOGEN ACTIVATOR (u-PA) protease domain V38D/V41R/L97bT/C122S/Y151F/R217E
IIGGEFTTIENQPWFAAIYRRHRGGSDTYRCGGSLISPCWVISATHCFIDYPKKEDYIVYLGRSRLNSNTQGEMKFEVENLILHKDYSADTTAHHNDIALLKIRSKEGRCAQPSRTIQTISLPSMYNDPQFGTSCEITGFGKENSTDYLFPEQLKMTVVKLISHRECQQPHYYGSEVTTKMLCAADPQWKTDSCQGDSGGPLVCSLQGRMTLTGIVSWGEGCALKDKPGVYTRVSHFLPWIRSHTKEENGLAL

SEQ ID NO: 857 - protein, 253 aa, synthetic construct
  REGION 1..253: note = UROKINASE-TYPE PLASMINOGEN ACTIVATOR (u-PA) protease domain V38D/V41K/L97bA/H99L/C122S/Y151R/R217E
IIGGEFTTIENQPWFAAIYRRHRGGSDTYKCGGSLISPCWVISATHCFIDYPKKEDYIVYLGRSRLNSNTQGEMKFEVENLILHKDYSADTAALHNDIALLKIRSKEGRCAQPSRTIQTISLPSMYNDPQFGTSCEITGFGKENSTDYLRPEQLKMTVVKLISHRECQQPHYYGSEVTTKMLCAADPQWKTDSCQGDSGGPLVCSLQGRMTLTGIVSWGEGCALKDKPGVYTRVSHFLPWIRSHTKEENGLAL

SEQ ID NO: 858 - protein, 253 aa, synthetic construct
  REGION 1..253: note = UROKINASE-TYPE PLASMINOGEN ACTIVATOR (u-PA) protease domain V38D/V41R/L97bN/H99E/C122S/E175D/Q192M/R217E
IIGGEFTTIENQPWFAAIYRRHRGGSDTYRCGGSLISPCWVISATHCFIDYPKKEDYIVYLGRSRLNSNTQGEMKFEVENLILHKDYSADTNAEHNDIALLKIRSKEGRCAQPSRTIQTISLPSMYNDPQFGTSCEITGFGKENSTDYLYPEQLKMTVVKLISHRECQQPHYYGSDVTTKMLCAADPQWKTDSCMGDSGGPLVCSLQGRMTLTGIVSWGEGCALKDKPGVYTRVSHFLPWIRSHTKEENGLAL

SEQ ID NO: 859 - protein, 253 aa, synthetic construct
  REGION 1..253: note = UROKINASE-TYPE PLASMINOGEN ACTIVATOR (u-PA) protease domain R36H/V38D/T97aR/L97bG/H99Q/C122S/E175F
IIGGEFTTIENQPWFAAIYRHHRGGSDTYVCGGSLISPCWVISATHCFIDYPKKEDYIVYLGRSRLNSNTQGEMKFEVENLILHKDYSADRGAQHNDIALLKIRSKEGRCAQPSRTIQTISLPSMYNDPQFGTSCEITGFGKENSTDYLYPEQLKMTVVKLISHRECQQPHYYGSFVTTKMLCAADPQWKTDSCQGDSGGPLVCSLQGRMTLTGIVSWGRGCALKDKPGVYTRVSHFLPWIRSHTKEENGLAL

SEQ ID NO: 860 - protein, 253 aa, synthetic construct
  REGION 1..253: note = UROKINASE-TYPE PLASMINOGEN ACTIVATOR (u-PA) protease domain R35S/V38D/V41L/D60aP/Y60bW/L97bG/H99Q/C122S
IIGGEFTTIENQPWFAAIYSRHRGGSDTYLCGGSLISPCWVISATHCFIPWPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 861 - protein, 253 aa, synthetic construct
  REGION 1..253: note = UROKINASE-TYPE PLASMINOGEN ACTIVATOR (u-PA) protease domain V38D/V41R/D60aQ/Y60bP/L97bG/H99Q/C122S
IIGGEFTTIENQPWFAAIYRRHRGGSDTYRCGGSLISPCWVISATHCFIQPPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 862 - protein, 253 aa, synthetic construct
  REGION 1..253: note = UROKINASE-TYPE PLASMINOGEN ACTIVATOR (u-PA) protease domain R35Q/V38D/Y40H/V41L/Y60bD/L97bG/H99Q/C122S
IIGGEFTTIENQPWFAAIYQRHRGGSDTHLCGGSLISPCWVISATHCFIDDPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 863 - protein, 253 aa, synthetic construct
  REGION 1..253: note = UROKINASE-TYPE PLASMINOGEN ACTIVATOR (u-PA) protease domain R37aS/V38D/V41R/D60aT/Y60bN/L97bG/H99Q/C122S
IIGGEFTTIENQPWFAAIYRRHSGGSDTYRCGGSLISPCWVISATHCFITNPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 864 - protein, 253 aa, synthetic construct
  REGION 1..253: note = UROKINASE-TYPE PLASMINOGEN ACTIVATOR (u-PA) protease domain R35K/V38D/Y40H/Y60bP/L97bG/H99Q/C122S
IIGGEFTTIENQPWFAAIYKRHRGGSDTHVCGGSLISPCWVISATHCFIDPPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 865 - protein, 253 aa, synthetic construct
  REGION 1..253: note = UROKINASE-TYPE PLASMINOGEN ACTIVATOR (u-PA) protease domain R35Q/V38D/Y40M/V41R/Y60bA/L97bG/H99Q/C122S
IIGGEFTTIENQPWFAAIYQRHRGGSDTMRCGGSLISPCWVISATHCFIDAPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 866 - protein, 253 aa, synthetic construct
  REGION 1..253: note = UROKINASE-TYPE PLASMINOGEN ACTIVATOR (u-PA) protease domain R35K/V38D/Y40F/V41R/Y60bT/L97bG/H99Q/C122S
IIGGEFTTIENQPWFAAIYKRHRGGSDTFRCGGSLISPCWVISATHCFIDTPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 867 - protein, 253 aa, synthetic construct
  REGION 1..253: note = UROKINASE-TYPE PLASMINOGEN ACTIVATOR (u-PA) protease domain R35Q/V38D/Y40F/V41T/Y60bP/L97bG/H99Q/C122S
IIGGEFTTIENQPWFAAIYQRHRGGSDTFTCGGSLISPCWVISATHCFIDPPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 868 - protein, 253 aa, synthetic construct
  REGION 1..253: note = UROKINASE-TYPE PLASMINOGEN ACTIVATOR (u-PA) protease domain V38D/T39W/Y40L/V41R/T97aL/L97bA/H99Q/C122S
IIGGEFTTIENQPWFAAIYRRHRGGSDWLRCGGSLISPCWVISATHCFIDYPKKEDYIVYLGRSRLNSNTQGEMKFEVENLILHKDYSADLAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 869 - protein, 253 aa, synthetic construct
  REGION 1..253: note = UROKINASE-TYPE PLASMINOGEN ACTIVATOR (u-PA) protease domain V38D/T39F/Y40L/V41R/T97aW/L97bA/H99Q/C122S
IIGGEFTTIENQPWFAAIYRRHRGGSDFLRCGGSLISPCWVISATHCFIDYPKKEDYIVYLGRSRLNSNTQGEMKFEVENLILHKDYSADWAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 870 - protein, 253 aa, synthetic construct
  REGION 1..253: note = UROKINASE-TYPE PLASMINOGEN ACTIVATOR (u-PA) protease domain V38D/T39Y/Y40Q/V41L/T97aY/L97bA/H99Q/C122S
IIGGEFTTIENQPWFAAIYRRHRGGSDYQLCGGSLISPCWVISATHCFIDYPKKEDYIVYLGRSRLNSNTQGEMKFEVENLILHKDYSADYAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 871 - protein, 253 aa, synthetic construct
  REGION 1..253: note = UROKINASE-TYPE PLASMINOGEN ACTIVATOR (u-PA) protease domain R37aS/V38D/T39Y/Y40M/V41R/T97aL/L97bA/H99Q/C122S
IIGGEFTTIENQPWFAAIYRRHSGGSDYMRCGGSLISPCWVISATHCFIDYPKKEDYIVYLGRSRLNSNTQGEMKFEVENLILHKDYSADLAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 872 - protein, 253 aa, synthetic construct
  REGION 1..253: note = UROKINASE-TYPE PLASMINOGEN ACTIVATOR (u-PA) protease domain V38D/T39L/Y40L/V41R/T97aV/L97bA/H99Q/C122S
IIGGEFTTIENQPWFAAIYRRHRGGSDLLRCGGSLISPCWVISATHCFIDYPKKEDYIVYLGRSRLNSNTQGEMKFEVENLILHKDYSADVAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 873 - protein, 253 aa, synthetic construct
  REGION 1..253: note = UROKINASE-TYPE PLASMINOGEN ACTIVATOR (u-PA) protease domain V38D/T39L/Y40L/V41R/T97aI/L97bA/H99Q/C122S
IIGGEFTTIENQPWFAAIYRRHRGGSDLLRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 874 - protein, 253 aa, synthetic construct
  REGION 1..253: note = UROKINASE-TYPE PLASMINOGEN ACTIVATOR (u-PA) protease domain V38D/T39L/Y40L/V41R/T97aW/L97bA/H99Q/C122S
IIGGEFTTIENQPWFAAIYRRHRGGSDLLRCGGSLISPCWVISATHCFIDYPKKEDYIVYLGRSRLNSNTQGEMKFEVENLILHKDYSADWAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 875 - protein, 253 aa, synthetic construct
  REGION 1..253: note = UROKINASE-TYPE PLASMINOGEN ACTIVATOR (u-PA) protease domain V38D/T39Y/Y40H/V41R/T97aI/L97bA/H99Q/C122S
IIGGEFTTIENQPWFAAIYRRHRGGSDYHRCGGSLISPCWVISATHCFIDYPKKEDYIVYLGRSRLNSNTQGEMKFEVENLILHKDYSADIAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 876 - protein, 253 aa, synthetic construct
  REGION 1..253: note = UROKINASE-TYPE PLASMINOGEN ACTIVATOR (u-PA) protease domain V38D/T39Y/Y40L/V41R/T97aW/L97bA/H99Q/C122S
IIGGEFTTIENQPWFAAIYRRHRGGSDYLRCGGSLISPCWVISATHCFIDYPKKEDYIVYLGRSRLNSNTQGEMKFEVENLILHKDYSADWAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 877 - protein, 253 aa, synthetic construct
  REGION 1..253: note = UROKINASE-TYPE PLASMINOGEN ACTIVATOR (u-PA) protease domain V38D/T39Y/Y40M/V41R/T97aW/L97bA/H99Q/C122S
IIGGEFTTIENQPWFAAIYRRHRGGSDYMRCGGSLISPCWVISATHCFIDYPKKEDYIVYLGRSRLNSNTQGEMKFEVENLILHKDYSADWAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 878 - protein, 253 aa, synthetic construct
  REGION 1..253: note = UROKINASE-TYPE PLASMINOGEN ACTIVATOR (u-PA) protease domain V38D/T39Y/Y40L/V41R/T97aE/L97bA/H99Q/C122S
IIGGEFTTIENQPWFAAIYRRHRGGSDYLRCGGSLISPCWVISATHCFIDYPKKEDYIVYLGRSRLNSNTQGEMKFEVENLILHKDYSADEAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 879 - protein, 253 aa, synthetic construct
  REGION 1..253: note = UROKINASE-TYPE PLASMINOGEN ACTIVATOR (u-PA) protease domain V38D/T39Y/Y40M/V41R/T97aE/L97bA/H99Q/C122S
IIGGEFTTIENQPWFAAIYRRHRGGSDYMRCGGSLISPCWVISATHCFIDYPKKEDYIVYLGRSRLNSNTQGEMKFEVENLILHKDYSADEAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 880 - protein, 253 aa, synthetic construct
  REGION 1..253: note = UROKINASE-TYPE PLASMINOGEN ACTIVATOR (u-PA) protease domain R35S/V38D/V41T/L97bR/H99Q/C122S/Y151L/R217E
IIGGEFTTIENQPWFAAIYSRHRGGSDTYTCGGSLISPCWVISATHCFIDYPKKEDYIVYLGRSRLNSNTQGEMKFEVENLILHKDYSADTRAQHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCQGDSGGPLVCSLQGRMTLTGIVSWGEGCALKDKPGVYTRVSHFLPWIRSHTKEENGLAL

SEQ ID NO: 881 - protein, 253 aa, synthetic construct
  REGION 1..253: note = UROKINASE-TYPE PLASMINOGEN ACTIVATOR (u-PA) protease domain V38D/V41R/L97bR/H99Q/C122S/Y151L/R217E
IIGGEFTTIENQPWFAAIYRRHRGGSDTYRCGGSLISPCWVISATHCFIDYPKKEDYIVYLGRSRLNSNTQGEMKFEVENLILHKDYSADTRAQHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCQGDSGGPLVCSLQGRMTLTGIVSWGEGCALKDKPGVYTRVSHFLPWIRSHTKEENGLAL

SEQ ID NO: 882 - protein, 253 aa, synthetic construct
  REGION 1..253: note = UROKINASE-TYPE PLASMINOGEN ACTIVATOR (u-PA) protease domain V38D/V41R/L97bR/H99E/C122S/Y151L/R217E
IIGGEFTTIENQPWFAAIYRRHRGGSDTYRCGGSLISPCWVISATHCFIDYPKKEDYIVYLGRSRLNSNTQGEMKFEVENLILHKDYSADTRAEHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCQGDSGGPLVCSLQGRMTLTGIVSWGEGCALKDKPGVYTRVSHFLPWIRSHTKEENGLAL

SEQ ID NO: 883 - protein, 253 aa, synthetic construct
  REGION 1..253: note = UROKINASE-TYPE PLASMINOGEN ACTIVATOR (u-PA) protease domain R35H/V38D/V41Q/L97bR/H99Q/C122S/Y151L/R217V
IIGGEFTTIENQPWFAAIYHRHRGGSDTYQCGGSLISPCWVISATHCFIDYPKKEDYIVYLGRSRLNSNTQGEMKFEVENLILHKDYSADTRAQHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCQGDSGGPLVCSLQGRMTLTGIVSWGVGCALKDKPGVYTRVSHFLPWIRSHTKEENGLAL

SEQ ID NO: 884 - protein, 253 aa, synthetic construct
  REGION 1..253: note = UROKINASE-TYPE PLASMINOGEN ACTIVATOR (u-PA) protease domain V38D/V41R/L97bR/H99Q/C122S/Y151L/R217V
IIGGEFTTIENQPWFAAIYRRHRGGSDTYRCGGSLISPCWVISATHCFIDYPKKEDYIVYLGRSRLNSNTQGEMKFEVENLILHKDYSADTRAQHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCQGDSGGPLVCSLQGRMTLTGIVSWGVGCALKDKPGVYTRVSHFLPWIRSHTKEENGLAL

SEQ ID NO: 885 - protein, 253 aa, synthetic construct
  REGION 1..253: note = UROKINASE-TYPE PLASMINOGEN ACTIVATOR (u-PA) protease domain R37aS/V38D/V41R/L97bR/H99Q/C122S/Y151L/Q192T/R217V
IIGGEFTTIENQPWFAAIYRRHSGGSDTYRCGGSLISPCWVISATHCFIDYPKKEDYIVYLGRSRLNSNTQGEMKFEVENLILHKDYSADTRAQHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCTGDSGGPLVCSLQGRMTLTGIVSWGVGCALKDKPGVYTRVSHFLPWIRSHTKEENGLAL

SEQ ID NO: 886 - protein, 253 aa, synthetic construct
  REGION 1..253: note = UROKINASE-TYPE PLASMINOGEN ACTIVATOR (u-PA) protease domain V38D/T39Y/Y40L/V41K/L97bR/H99L/C122S/E175D
IIGGEFTTIENQPWFAAIYRRHRGGSDYLKCGGSLISPCWVISATHCFIDYPKKEDYIVYLGRSRLNSNTQGEMKFEVENLILHKDYSADTRALHNDIALLKIRSKEGRCAQPSRTIQTISLPSMYNDPQFGTSCEITGFGKENSTDYLYPEQLKMTVVKLISHRECQQPHYYGSDVTTKMLCAADPQWKTDSCQGDSGGPLVCSLQGRMTLTGIVSWGRGCALKDKPGVYTRVSHFLPWIRSHTKEENGLAL

SEQ ID NO: 887 - protein, 253 aa, synthetic construct
  REGION 1..253: note = UROKINASE-TYPE PLASMINOGEN ACTIVATOR (u-PA) protease domain R35Q/H37G/R37aN/V38F/T39H/V41Q/Y60bR/T97aL/L97bR/H 99E/C122S/Y151L/E175D/Q192T/R217E/K224R
IIGGEFTTIENQPWFAAIYQRGNGGSFHYQCGGSLISPCWVISATHCFIDRPKKEDYIVYLGRSRLNSNTQGEMKFEVENLILHKDYSADLRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDRPGVYTRVSHFLPWIRSHTKEENGLAL

SEQ ID NO: 888 - protein, 253 aa, synthetic construct
  REGION 1..253: note = UROKINASE-TYPE PLASMINOGEN ACTIVATOR (u-PA) protease domain H37N/R37aD/V38Y/T39F/V41Q/Y60bR/T97aW/L97bR/H99E/C 122S/Y151L/E175D/Q192T/R217E/K224R
IIGGEFTTIENQPWFAAIYRRNDGGSYFYQCGGSLISPCWVISATHCFIDRPKKEDYIVYLGRSRLNSNTQGEMKFEVENLILHKDYSADWRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDRPGVYTRVSHFLPWIRSHTKEENGLAL

SEQ ID NO: 889 - protein, 253 aa, synthetic construct
  REGION 1..253: note = UROKINASE-TYPE PLASMINOGEN ACTIVATOR (u-PA) protease domain H37A/R37aE/V38F/T39L/V41Q/Y60bR/T97aF/L97bR/H99E/C 122S/Y151L/E175D/Q192T/R217E/K224R
IIGGEFTTIENQPWFAAIYRRAEGGSFLYQCGGSLISPCWVISATHCFIDRPKKEDYIVYLGRSRLNSNTQGEMKFEVENLILHKDYSADFRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDRPGVYTRVSHFLPWIRSHTKEENGLAL

SEQ ID NO: 890 - protein, 253 aa, synthetic construct
  REGION 1..253: note = UROKINASE-TYPE PLASMINOGEN ACTIVATOR (u-PA) protease domain R35K/H37G/R37aE/G37bS/V38F/T39H/V41Q/Y60bR/T97aW/L 97bR/H99E/C122S/Y151L/E175D/Q192T/R217E/K224R
IIGGEFTTIENQPWFAAIYKRGESGSFHYQCGGSLISPCWVISATHCFIDRPKKEDYIVYLGRSRLNSNTQGEMKFEVENLILHKDYSADWRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDRPGVYTRVSHFLPWIRSHTKEENGLAL

SEQ ID NO: 891 - protein, 253 aa, synthetic construct
  REGION 1..253: note = UROKINASE-TYPE PLASMINOGEN ACTIVATOR (u-PA) protease domain H37A/R37aE/V38F/T39L/V41Q/Y60bR/T97aW/L97bR/H99E/C 122S/Y151L/E175D/Q192T/R217E/K224R
IIGGEFTTIENQPWFAAIYRRAEGGSFLYQCGGSLISPCWVISATHCFIDRPKKEDYIVYLGRSRLNSNTQGEMKFEVENLILHKDYSADWRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDRPGVYTRVSHFLPWIRSHTKEENGLAL

SEQ ID NO: 892 - protein, 253 aa, synthetic construct
  REGION 1..253: note = UROKINASE-TYPE PLASMINOGEN ACTIVATOR (u-PA) protease domain H37N/R37aE/V38F/T39L/V41Q/Y60bR/T97aW/L97bR/H99E/C 122S/Y151L/E175D/Q192T/R217E/K224R
IIGGEFTTIENQPWFAAIYRRNEGGSFLYQCGGSLISPCWVISATHCFIDRPKKEDYIVYLGRSRLNSNTQGEMKFEVENLILHKDYSADWRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDRPGVYTRVSHFLPWIRSHTKEENGLAL

SEQ ID NO: 893 - protein, 253 aa, synthetic construct
  REGION 1..253: note = UROKINASE-TYPE PLASMINOGEN ACTIVATOR (u-PA) protease domain R35G/H37T/R37aE/V38T/T39Y/V41Q/Y60bR/T97aF/L97bR/H 99E/C122S/Y151L/E175D/Q192T/R217E/K224R
IIGGEFTTIENQPWFAAIYGRTEGGSTYYQCGGSLISPCWVISATHCFIDRPKKEDYIVYLGRSRLNSNTQGEMKFEVENLILHKDYSADFRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDRPGVYTRVSHFLPWIRSHTKEENGLAL

SEQ ID NO: 894 - protein, 253 aa, synthetic construct
  REGION 1..253: note = UROKINASE-TYPE PLASMINOGEN ACTIVATOR (u-PA) protease domain R35K/H37S/R37aE/V38F/T39Y/V41Q/Y60bR/T97aL/L97bR/H 99E/C122S/Y151L/E175D/Q192T/R217E/K224R
IIGGEFTTIENQPWFAAIYKRSEGGSFYYQCGGSLISPCWVISATHCFIDRPKKEDYIVYLGRSRLNSNTQGEMKFEVENLILHKDYSADLRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDRPGVYTRVSHFLPWIRSHTKEENGLAL

SEQ ID NO: 895 - protein, 253 aa, synthetic construct
  REGION 1..253: note = UROKINASE-TYPE PLASMINOGEN ACTIVATOR (u-PA) protease domain H37A/R37aE/V38Y/T39Y/V41Q/Y60bR/T97aV/L97bR/H99E/C 122S/Y151L/E175D/Q192T/R217E/K224R
IIGGEFTTIENQPWFAAIYRRAEGGSYYYQCGGSLISPCWVISATHCFIDRPKKEDYIVYLGRSRLNSNTQGEMKFEVENLILHKDYSADVRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDRPGVYTRVSHFLPWIRSHTKEENGLAL

SEQ ID NO: 896 - protein, 253 aa, synthetic construct
  REGION 1..253: note = UROKINASE-TYPE PLASMINOGEN ACTIVATOR (u-PA) protease domain H37D/R37aD/V38Y/T39Y/V41Q/Y60bR/T97aL/L97bR/H99E/C 122S/Y151L/E175D/Q192T/R217E/K224R
IIGGEFTTIENQPWFAAIYRRDDGGSYYYQCGGSLISPCWVISATHCFIDRPKKEDYIVYLGRSRLNSNTQGEMKFEVENLILHKDYSADLRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDRPGVYTRVSHFLPWIRSHTKEENGLAL

SEQ ID NO: 897 - protein, 253 aa, synthetic construct
  REGION 1..253: note = UROKINASE-TYPE PLASMINOGEN ACTIVATOR (u-PA) protease domain H37A/R37aD/V38Y/T39Y/V41Q/Y60bR/T97aD/L97bR/H99E/C 122S/Y151L/E175D/Q192T/R217E/K224R
IIGGEFTTIENQPWFAAIYRRADGGSYYYQCGGSLISPCWVISATHCFIDRPKKEDYIVYLGRSRLNSNTQGEMKFEVENLILHKDYSADDRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDRPGVYTRVSHFLPWIRSHTKEENGLAL

SEQ ID NO: 898 - protein, 253 aa, synthetic construct
  REGION 1..253: note = UROKINASE-TYPE PLASMINOGEN ACTIVATOR (u-PA) protease domain H37S/R37aD/V38H/T39L/V41Q/Y60bR/T97aW/L97bR/H99E/C 122S/Y151L/E175D/Q192T/R217E/K224R
IIGGEFTTIENQPWFAAIYRRSDGGSHLYQCGGSLISPCWVISATHCFIDRPKKEDYIVYLGRSRLNSNTQGEMKFEVENLILHKDYSADWRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDRPGVYTRVSHFLPWIRSHTKEENGLAL

SEQ ID NO: 899 - protein, 253 aa, synthetic construct
  REGION 1..253: note = UROKINASE-TYPE PLASMINOGEN ACTIVATOR (u-PA) protease domain H37G/R37aD/V38Y/T39H/V41Q/Y60bR/T97aD/L97bR/H99E/C 122S/Y151L/E175D/Q192T/R217E/K224R
IIGGEFTTIENQPWFAAIYRRGDGGSYHYQCGGSLISPCWVISATHCFIDRPKKEDYIVYLGRSRLNSNTQGEMKFEVENLILHKDYSADDRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDRPGVYTRVSHFLPWIRSHTKEENGLAL

SEQ ID NO: 900 - protein, 253 aa, synthetic construct
  REGION 1..253: note = UROKINASE-TYPE PLASMINOGEN ACTIVATOR (u-PA) protease domain H37G/R37aD/G37bD/V38F/T39H/V41R/Y60bK/T97aS/L97bR/ H99E/C122S/Y151L/E175D/Q192T/R217E/K224R
IIGGEFTTIENQPWFAAIYRRGDDGSFHYRCGGSLISPCWVISATHCFIDKPKKEDYIVYLGRSRLNSNTQGEMKFEVENLILHKDYSADSRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDRPGVYTRVSHFLPWIRSHTKEENGLAL

SEQ ID NO: 901 - protein, 253 aa, synthetic construct
  REGION 1..253: note = UROKINASE-TYPE PLASMINOGEN ACTIVATOR (u-PA) protease domain R35Q/H37G/R37aE/V38Y/T39H/V41R/Y60bK/T97aS/L97bR/H 99E/C122S/Y151L/E175D/Q192T/R217E/K224R
IIGGEFTTIENQPWFAAIYQRGEGGSYHYRCGGSLISPCWVISATHCFIDKPKKEDYIVYLGRSRLNSNTQGEMKFEVENLILHKDYSADSRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDRPGVYTRVSHFLPWIRSHTKEENGLAL

SEQ ID NO: 902 - protein, 253 aa, synthetic construct
  REGION 1..253: note = UROKINASE-TYPE PLASMINOGEN ACTIVATOR (u-PA) protease domain R35K/H37A/R37aE/V38H/T39Y/V41R/Y60bK/T97aS/L97bR/H 99E/C122S/Y151L/E175D/Q192T/R217E/K224R
IIGGEFTTIENQPWFAAIYKRAEGGSHYYRCGGSLISPCWVISATHCFIDKPKKEDYIVYLGRSRLNSNTQGEMKFEVENLILHKDYSADSRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDRPGVYTRVSHFLPWIRSHTKEENGLAL

SEQ ID NO: 903 - protein, 253 aa, synthetic construct
  REGION 1..253: note = UROKINASE-TYPE PLASMINOGEN ACTIVATOR (u-PA) protease domain R35Q/H37G/R37aE/V38Y/T39F/V41R/Y60bK/T97aS/L97bR/H 99E/C122S/Y151L/E175D/Q192T/R217E/K224R
IIGGEFTTIENQPWFAAIYQRGEGGSYFYRCGGSLISPCWVISATHCFIDKPKKEDYIVYLGRSRLNSNTQGEMKFEVENLILHKDYSADSRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDRPGVYTRVSHFLPWIRSHTKEENGLAL

SEQ ID NO: 904 - protein, 253 aa, synthetic construct
  REGION 1..253: note = UROKINASE-TYPE PLASMINOGEN ACTIVATOR (u-PA) protease domain R35Q/H37G/R37aE/V38W/T39Y/V41R/Y60bK/T97aS/L97bR/H 99E/C122S/Y151L/E175D/Q192T/R217E/K224R
IIGGEFTTIENQPWFAAIYQRGEGGSWYYRCGGSLISPCWVISATHCFIDKPKKEDYIVYLGRSRLNSNTQGEMKFEVENLILHKDYSADSRAEHNDIALLKIRSKEGRCAQPSRTIQTISLPSMYNDPQFGTSCEITGFGKENSTDYLLPEQLKMTVVKLISHRECQQPHYYGSDVTTKMLCAADPQWKTDSCTGDSGGPLVCSLQGRMTLTGIVSWGEGCALKDRPGVYTRVSHFLPWIRSHTKEENGLAL

SEQ ID NO: 905 - protein, 253 aa, synthetic construct
  REGION 1..253: note = UROKINASE-TYPE PLASMINOGEN ACTIVATOR (u-PA) protease domain R36L/V38D/T39R/Y40L/V41T/L97bD/H99P/C122S/R217S
IIGGEFTTIENQPWFAAIYRLHRGGSDRLTCGGSLISPCWVISATHCFIDYPKKEDYIVYLGRSRLNSNTQGEMKFEVENLILHKDYSADTDAPHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGSGCALKDKPGVYTRVSHFLPWIRSHTKEENGLAL

SEQ ID NO: 906 - protein, 253 aa, synthetic construct
  REGION 1..253: note = UROKINASE-TYPE PLASMINOGEN ACTIVATOR (u-PA) protease domain V38D/T39V/V41R/L97bV/H99E/C122S/R217E
IIGGEFTTIENQPWFAAIYRRHRGGSDVYRCGGSLISPCWVISATHCFIDYPKKEDYIVYLGRSRLNSNTQGEMKFEVENLILHKDYSADTVAEHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGEGCALKDKPGVYTRVSHFLPWIRSHTKEENGLAL

SEQ ID NO: 907 - protein, 253 aa, synthetic construct
  REGION 1..253: note = UROKINASE-TYPE PLASMINOGEN ACTIVATOR (u-PA) protease domain R37aH/V38D/T39M/Y40A/V41K/L97bR/H99Q/C122S/R217E
IIGGEFTTIENQPWFAAIYRRHHGGSDMAKCGGSLISPCWVISATHCFIDYPKKEDYIVYLGRSRLNSNTQGEMKFEVENLILHKDYSADTRAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGEGCALKDKPGVYTRVSHFLPWIRSHTKEENGLAL

SEQ ID NO: 908 - protein, 253 aa, synthetic construct
  REGION 1..253: note = UROKINASE-TYPE PLASMINOGEN ACTIVATOR (u-PA) protease domain R36S/V38D/T39H/Y40L/V41R/L97bV/H99V/C122S/R217Q
IIGGEFTTIENQPWFAAIYRSHRGGSDHLRCGGSLISPCWVISATHCFIDYPKKEDYIVYLGRSRLNSNTQGEMKFEVENLILHKDYSADTVAVHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGQGCALKDKPGVYTRVSHFLPWIRSHTKEENGLAL

SEQ ID NO: 909 - protein, 253 aa, synthetic construct
  REGION 1..253: note = UROKINASE-TYPE PLASMINOGEN ACTIVATOR (u-PA) protease domain R36S/V38D/T39K/Y40F/V41R/L97bN/H99E/C122S/R217S
IIGGEFTTIENQPWFAAIYRSHRGGSDKFRCGGSLISPCWVISATHCFIDYPKKEDYIVYLGRSRLNSNTQGEMKFEVENLILHKDYSADTNAEHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGSGCALKDKPGVYTRVSHFLPWIRSHTKEENGLAL

SEQ ID NO: 910 - protein, 253 aa, synthetic construct
  REGION 1..253: note = UROKINASE-TYPE PLASMINOGEN ACTIVATOR (u-PA) protease domain V38D/T39K/Y40F/V41Q/L97bI/H99S/C122S/R217T
IIGGEFTTIENQPWFAAIYRRHRGGSDKFQCGGSLISPCWVISATHCFIDYPKKEDYIVYLGRSRLNSNTQGEMKFEVENLILHKDYSADTIASHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGTGCALKDKPGVYTRVSHFLPWIRSHTKEENGLAL

SEQ ID NO: 911 - protein, 253 aa, synthetic construct
  REGION 1..253: note = UROKINASE-TYPE PLASMINOGEN ACTIVATOR (u-PA) protease domain R36H/V38D/T39R/Y40F/V41R/H99S/C122S/R217T
IIGGEFTTIENQPWFAAIYRHHRGGSDRFRCGGSLISPCWVISATHCFIDYPKKEDYIVYLGRSRLNSNTQGEMKFEVENLILHKDYSADTLASHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGTGCALKDKPGVYTRVSHFLPWIRSHTKEENGLAL

SEQ ID NO: 912 - protein, 253 aa, synthetic construct
  REGION 1..253: note = UROKINASE-TYPE PLASMINOGEN ACTIVATOR (u-PA) protease domain R37aP/V38D/T39Y/V41R/L97bV/H99Q/C122S/R217T
IIGGEFTTIENQPWFAAIYRRHPGGSDYYRCGGSLISPCWVISATHCFIDYPKKEDYIVYLGRSRLNSNTQGEMKFEVENLILHKDYSADTVAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGTGCALKDKPGVYTRVSHFLPWIRSHTKEENGLAL

SEQ ID NO: 913 - protein, 253 aa, synthetic construct
  REGION 1..253: note = UROKINASE-TYPE PLASMINOGEN ACTIVATOR (u-PA) protease domain R36S/V38D/T39K/Y40M/V41K/L97bI/C122S/R217E
IIGGEFTTIENQPWFAAIYRSHRGGSDKMKCGGSLISPCWVISATHCFIDYPKKEDYIVYLGRSRLNSNTQGEMKFEVENLILHKDYSADTIAHHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGEGCALKDKPGVYTRVSHFLPWIRSHTKEENGLAL

SEQ ID NO: 914 - protein, 253 aa, synthetic construct
  REGION 1..253: note = UROKINASE-TYPE PLASMINOGEN ACTIVATOR (u-PA) protease domain V38D/T39H/Y40F/V41K/L97bM/H99T/C122S/R217E
IIGGEFTTIENQPWFAAIYRRHRGGSDHFKCGGSLISPCWVISATHCFIDYPKKEDYIVYLGRSRLNSNTQGEMKFEVENLILHKDYSADTMATHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGEGCALKDKPGVYTRVSHFLPWIRSHTKEENGLAL

SEQ ID NO: 915 - protein, 253 aa, synthetic construct
  REGION 1..253: note = UROKINASE-TYPE PLASMINOGEN ACTIVATOR (u-PA) protease domain R36S/V38D/T39K/Y40M/V41K/L97bH/H99T/C122S/R217S
IIGGEFTTIENQPWFAAIYRSHRGGSDKMKCGGSLISPCWVISATHCFIDYPKKEDYIVYLGRSRLNSNTQGEMKFEVENLILHKDYSADTHATHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGSGCALKDKPGVYTRVSHFLPWIRSHTKEENGLAL

SEQ ID NO: 916 - protein, 253 aa, synthetic construct
  REGION 1..253: note = UROKINASE-TYPE PLASMINOGEN ACTIVATOR (u-PA) protease domain V38D/T39L/Y40L/V41K/L97bH/H99L/C122S/R217A
IIGGEFTTIENQPWFAAIYRRHRGGSDLLKCGGSLISPCWVISATHCFIDYPKKEDYIVYLGRSRLNSNTQGEMKFEVENLILHKDYSADTHALHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGAGCALKDKPGVYTRVSHFLPWIRSHTKEENGLAL

SEQ ID NO: 917 - protein, 253 aa, synthetic construct
  REGION 1..253: note = UROKINASE-TYPE PLASMINOGEN ACTIVATOR (u-PA) protease domain V38D/T39F/Y40L/V41K/L97bT/H99S/C122S/R217T
IIGGEFTTIENQPWFAAIYRRHRGGSDFLKCGGSLISPCWVISATHCFIDYPKKEDYIVYLGRSRLNSNTQGEMKFEVENLILHKDYSADTTASHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGTGCALKDKPGVYTRVSHFLPWIRSHTKEENGLAL

SEQ ID NO: 918 - protein, 253 aa, synthetic construct
  REGION 1..253: note = UROKINASE-TYPE PLASMINOGEN ACTIVATOR (u-PA) protease domain R36S/V38D/T39A/V41R/L97bV/H99S/C122S/R217T
IIGGEFTTIENQPWFAAIYRSHRGGSDAYRCGGSLISPCWVISATHCFIDYPKKEDYIVYLGRSRLNSNTQGEMKFEVENLILHKDYSADTVASHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGTGCALKDKPGVYTRVSHFLPWIRSHTKEENGLAL

SEQ ID NO: 919 - protein, 253 aa, synthetic construct
  REGION 1..253: note = UROKINASE-TYPE PLASMINOGEN ACTIVATOR (u-PA) protease domain R37aH/V38D/T39R/Y40F/L97bT/C122S/R217E
IIGGEFTTIENQPWFAAIYRRHHGGSDRFVCGGSLISPCWVISATHCFIDYPKKEDYIVYLGRSRLNSNTQGEMKFEVENLILHKDYSADTTAHHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGEGCALKDKPGVYTRVSHFLPWIRSHTKEENGLAL

SEQ ID NO: 920 - protein, 253 aa, synthetic construct
  REGION 1..253: note = UROKINASE-TYPE PLASMINOGEN ACTIVATOR (u-PA) protease domain R36S/V38D/T39K/Y40F/V41R/L97bI/H99E/C122S/R217S
IIGGEFTTIENQPWFAAIYRSHRGGSDKFRCGGSLISPCWVISATHCFIDYPKKEDYIVYLGRSRLNSNTQGEMKFEVENLILHKDYSADTIAEHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGSGCALKDKPGVYTRVSHFLPWIRSHTKEENGLAL

SEQ ID NO: 921 - protein, 253 aa, synthetic construct
  REGION 1..253: note = UROKINASE-TYPE PLASMINOGEN ACTIVATOR (u-PA) protease domain R36S/V38D/T39A/Y40F/V41R/L97bA/H99E/C122S/R217T
IIGGEFTTIENQPWFAAIYRSHRGGSDAFRCGGSLISPCWVISATHCFIDYPKKEDYIVYLGRSRLNSNTQGEMKFEVENLILHKDYSADTAAEHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGTGCALKDKPGVYTRVSHFLPWIRSHTKEENGLAL

SEQ ID NO: 922 - protein, 253 aa, synthetic construct
  REGION 1..253: note = UROKINASE-TYPE PLASMINOGEN ACTIVATOR (u-PA) protease domain R35Q/H37Y/R37aE/V38E/T39Y/V41R/L97bG/H99S/C122S
IIGGEFTTIENQPWFAAIYQRYEGGSEYYRCGGSLISPCWVISATHCFIDYPKKEDYIVYLGRSRLNSNTQGEMKFEVENLILHKDYSADTGASHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 923 - protein, 253 aa, synthetic construct
  REGION 1..253: note = UROKINASE-TYPE PLASMINOGEN ACTIVATOR (u-PA) protease domain R37aS/V38D/T39L/Y40L/V41R/L97bM/H99L/C122S/R217S
IIGGEFTTIENQPWFAAIYRRHSGGSDLLRCGGSLISPCWVISATHCFIDYPKKEDYIVYLGRSRLNSNTQGEMKFEVENLILHKDYSADTMALHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGSGCALKDKPGVYTRVSHFLPWIRSHTKEENGLAL

SEQ ID NO: 924 - protein, 253 aa, synthetic construct
  REGION 1..253: note = UROKINASE-TYPE PLASMINOGEN ACTIVATOR (u-PA) protease domain R36S/V38D/T39L/Y40L/V41R/L97bI/H99E/C122S/R217T
IIGGEFTTIENQPWFAAIYRSHRGGSDLLRCGGSLISPCWVISATHCFIDYPKKEDYIVYLGRSRLNSNTQGEMKFEVENLILHKDYSADTIAEHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGTGCALKDKPGVYTRVSHFLPWIRSHTKEENGLAL

SEQ ID NO: 925 - protein, 253 aa, synthetic construct
  REGION 1..253: note = UROKINASE-TYPE PLASMINOGEN ACTIVATOR (u-PA) protease domain R37aS/V38D/T39Y/Y40F/V41R/H99L/C122S/R217T
IIGGEFTTIENQPWFAAIYRRHSGGSDYFRCGGSLISPCWVISATHCFIDYPKKEDYIVYLGRSRLNSNTQGEMKFEVENLILHKDYSADTLALHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGTGCALKDKPGVYTRVSHFLPWIRSHTKEENGLAL

SEQ ID NO: 926 - protein, 253 aa, synthetic construct
  REGION 1..253: note = UROKINASE-TYPE PLASMINOGEN ACTIVATOR (u-PA) protease domain V38D/T39Y/Y40L/V41R/L97bI/H99E/C122S/R217E
IIGGEFTTIENQPWFAAIYRRHRGGSDYLRCGGSLISPCWVISATHCFIDYPKKEDYIVYLGRSRLNSNTQGEMKFEVENLILHKDYSADTIAEHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGEGCALKDKPGVYTRVSHFLPWIRSHTKEENGLAL

SEQ ID NO: 927 - protein, 253 aa, synthetic construct
  REGION 1..253: note = UROKINASE-TYPE PLASMINOGEN ACTIVATOR (u-PA) protease domain R37aP/V38D/T39L/Y40I/V41R/H99L/C122S/R217Q
IIGGEFTTIENQPWFAAIYRRHPGGSDLIRCGGSLISPCWVISATHCFIDYPKKEDYIVYLGRSRLNSNTQGEMKFEVENLILHKDYSADTLALHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGQGCALKDKPGVYTRVSHFLPWIRSHTKEENGLAL

SEQ ID NO: 928 - protein, 253 aa, synthetic construct
  REGION 1..253: note = UROKINASE-TYPE PLASMINOGEN ACTIVATOR (u-PA) protease domain V38D/T39V/Y40L/V41S/H99V/C122S/R217V
IIGGEFTTIENQPWFAAIYRRHRGGSDVLSCGGSLISPCWVISATHCFIDYPKKEDYIVYLGRSRLNSNTQGEMKFEVENLILHKDYSADTLAVHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGVGCALKDKPGVYTRVSHFLPWIRSHTKEENGLAL

SEQ ID NO: 929 - protein, 253 aa, synthetic construct
  REGION 1..253: note = UROKINASE-TYPE PLASMINOGEN ACTIVATOR (u-PA) protease domain R37aS/V38D/T39V/V41E/L97bG/H99Q/C122S/R217T
IIGGEFTTIENQPWFAAIYRRHSGGSDVYECGGSLISPCWVISATHCFIDYPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGTGCALKDKPGVYTRVSHFLPWIRSHTKEENGLAL

SEQ ID NO: 930 - protein, 253 aa, synthetic construct
  REGION 1..253: note = UROKINASE-TYPE PLASMINOGEN ACTIVATOR (u-PA) protease domain R36S/V38D/T39S/V41R/L97bI/H99E/C122S/R217T
IIGGEFTTIENQPWFAAIYRSHRGGSDSYRCGGSLISPCWVISATHCFIDYPKKEDYIVYLGRSRLNSNTQGEMKFEVENLILHKDYSADTIAEHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGTGCALKDKPGVYTRVSHFLPWIRSHTKEENGLAL

SEQ ID NO: 931 - protein, 253 aa, synthetic construct
  REGION 1..253: note = UROKINASE-TYPE PLASMINOGEN ACTIVATOR (u-PA) protease domain R37aS/V38D/T39G/V41R/L97bM/H99E/C122S/R217S
IIGGEFTTIENQPWFAAIYRRHSGGSDGYRCGGSLISPCWVISATHCFIDYPKKEDYIVYLGRSRLNSNTQGEMKFEVENLILHKDYSADTMAEHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGSGCALKDKPGVYTRVSHFLPWIRSHTKEENGLAL

SEQ ID NO: 932 - protein, 253 aa, synthetic construct
  REGION 1..253: note = UROKINASE-TYPE PLASMINOGEN ACTIVATOR (u-PA) protease domain R37aS/V38D/T39Y/V41R/L97bI/H99E/C122S/R217T
IIGGEFTTIENQPWFAAIYRRHSGGSDYYRCGGSLISPCWVISATHCFIDYPKKEDYIVYLGRSRLNSNTQGEMKFEVENLILHKDYSADTIAEHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGTGCALKDKPGVYTRVSHFLPWIRSHTKEENGLAL

SEQ ID NO: 933 - protein, 253 aa, synthetic construct
  REGION 1..253: note = UROKINASE-TYPE PLASMINOGEN ACTIVATOR (u-PA) protease domain R35E/R37aD/V38E/Y40Q/V41L/Y60bN/L97bA/H99Q/C122S/Y 149R
IIGGEFTTIENQPWFAAIYERHDGGSETQLCGGSLISPCWVISATHCFIDNPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 934 - protein, 253 aa, synthetic construct
  REGION 1..253: note = UROKINASE-TYPE PLASMINOGEN ACTIVATOR (u-PA) protease domain R35S/R37aD/V38E/Y40Q/V41L/L97bA/H99Q/C122S/Y149R
IIGGEFTTIENQPWFAAIYSRHDGGSETQLCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 935 - protein, 253 aa, synthetic construct
  REGION 1..253: note = UROKINASE-TYPE PLASMINOGEN ACTIVATOR (u-PA) protease domain R35V/R37aD/V38E/Y40Q/V41L/Y60bG/T97aE/L97bA/H99Q/C 122S/Y149R
IIGGEFTTIENQPWFAAIYVRHDGGSETQLCGGSLISPCWVISATHCFIDGPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 936 - protein, 253 aa, synthetic construct
  REGION 1..253: note = UROKINASE-TYPE PLASMINOGEN ACTIVATOR (u-PA) protease domain R35S/R37aD/V38E/Y40Q/V41L/Y60bV/T97aL/L97bA/H99Q/C 122S/Y149L
IIGGEFTTIENQPWFAAIYSRHDGGSETQLCGGSLISPCWVISATHCFIDVPKKEDYIVYLGRSRLNSNTQGEMKFEVENLILHKDYSADLAAQHNDIALLKIRSKEGRCAQPSRTIQTISLPSMYNDPQFGTSCEITGFGKENSTDLLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 937 - protein, 253 aa, synthetic construct
  REGION 1..253: note = UROKINASE-TYPE PLASMINOGEN ACTIVATOR (u-PA) protease domain R37aP/V38E/Y40Q/V41L/Y60bE/L97bA/H99Q/C122S/Y149R
IIGGEFTTIENQPWFAAIYRRHPGGSETQLCGGSLISPCWVISATHCFIDEPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 938 - protein, 253 aa, synthetic construct
  REGION 1..253: note = UROKINASE-TYPE PLASMINOGEN ACTIVATOR (u-PA) protease domain R35M/R37aQ/V38E/Y40Q/V41L/Y60bE/T97aE/L97bA/H99Q/C 122S/Y149R
IIGGEFTTIENQPWFAAIYMRHQGGSETQLCGGSLISPCWVISATHCFIDEPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 939 - protein, 253 aa, synthetic construct
  REGION 1..253: note = UROKINASE-TYPE PLASMINOGEN ACTIVATOR (u-PA) protease domain R35S/R37aD/V38E/Y40Q/V41L/Y60bT/T97aE/L97bA/H99Q/C 122S/Y149R
IIGGEFTTIENQPWFAAIYSRHDGGSETQLCGGSLISPCWVISATHCFIDTPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 940 - protein, 253 aa, synthetic construct
  REGION 1..253: note = UROKINASE-TYPE PLASMINOGEN ACTIVATOR (u-PA) protease domain R35S/R37aA/V38E/Y40Q/V41L/L97bA/H99Q/C122S/Y149V
IIGGEFTTIENQPWFAAIYSRHAGGSETQLCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDVLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 941 - protein, 253 aa, synthetic construct
  REGION 1..253: note = UROKINASE-TYPE PLASMINOGEN ACTIVATOR (u-PA) protease domain R35K/R37aD/V38E/Y40Q/V41L/Y60bE/L97bA/H99Q/C122S/Y 149R
IIGGEFTTIENQPWFAAIYKRHDGGSETQLCGGSLISPCWVISATHCFIDEPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 942 - protein, 253 aa, synthetic construct
  REGION 1..253: note = UROKINASE-TYPE PLASMINOGEN ACTIVATOR (u-PA) protease domain R35V/R37aE/V38E/Y40Q/V41L/Y60bS/T97aE/L97bA/H99Q/C 122S/Y149R
IIGGEFTTIENQPWFAAIYVRHEGGSETQLCGGSLISPCWVISATHCFIDSPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 943 - protein, 253 aa, synthetic construct
  REGION 1..253: note = UROKINASE-TYPE PLASMINOGEN ACTIVATOR (u-PA) protease domain R35A/R37aE/V38E/Y40Q/V41L/L97bA/H99Q/C122S/Y149R
IIGGEFTTIENQPWFAAIYARHEGGSETQLCGGSLISPCWVISATHCFIDYPKKEDYIVYLGRSRLNSNTQGEMKFEVENLILHKDYSADTAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 944 - protein, 253 aa, synthetic construct
  REGION 1..253: note = UROKINASE-TYPE PLASMINOGEN ACTIVATOR (u-PA) protease domain R37aD/V38E/Y40Q/V41L/Y60bP/T97aE/L97bA/H99Q/C122S/ Y149R
IIGGEFTTIENQPWFAAIYRRHDGGSETQLCGGSLISPCWVISATHCFIDPPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 945 - protein, 253 aa, synthetic construct
  REGION 1..253: note = UROKINASE-TYPE PLASMINOGEN ACTIVATOR (u-PA) protease domain R35S/R37aD/V38E/Y40Q/V41L/T97aD/L97bA/H99Q/C122S/Y 149K
IIGGEFTTIENQPWFAAIYSRHDGGSETQLCGGSLISPCWVISATHCFIDYPKKEDYIVYLGRSRLNSNTQGEMKFEVENLILHKDYSADDAAQHNDIALLKIRSKEGRCAQPSRTIQTISLPSMYNDPQFGTSCEITGFGKENSTDKLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 946 - protein, 253 aa, synthetic construct
  REGION 1..253: note = UROKINASE-TYPE PLASMINOGEN ACTIVATOR (u-PA) protease domain R35A/R37aD/V38E/Y40Q/V41L/Y60bV/T97aE/L97bA/H99Q/C 122S/Y149K
IIGGEFTTIENQPWFAAIYARHDGGSETQLCGGSLISPCWVISATHCFIDVPKKEDYIVYLGRSRLNSNTQGEMKFEVENLILHKDYSADEAAQHNDIALLKIRSKEGRCAQPSRTIQTISLPSMYNDPQFGTSCEITGFGKENSTDKLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 947 - protein, 253 aa, synthetic construct
  REGION 1..253: note = UROKINASE-TYPE PLASMINOGEN ACTIVATOR (u-PA) protease domain R37aD/V38E/Y40Q/V41L/Y60bP/T97aV/L97bA/H99Q/C122S/ Y149K
IIGGEFTTIENQPWFAAIYRRHDGGSETQLCGGSLISPCWVISATHCFIDPPKKEDYIVYLGRSRLNSNTQGEMKFEVENLILHKDYSADVAAQHNDIALLKIRSKEGRCAQPSRTIQTISLPSMYNDPQFGTSCEITGFGKENSTDKLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 948 - protein, 253 aa, synthetic construct
  REGION 1..253: note = UROKINASE-TYPE PLASMINOGEN ACTIVATOR (u-PA) protease domain R35S/R37aD/V38E/Y40Q/V41L/T97aE/L97bA/H99Q/C122S/Y 149R
IIGGEFTTIENQPWFAAIYSRHDGGSETQLCGGSLISPCWVISATHCFIDYPKKEDYIVYLGRSRLNSNTQGEMKFEVENLILHKDYSADEAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 949 - protein, 253 aa, synthetic construct
  REGION 1..253: note = UROKINASE-TYPE PLASMINOGEN ACTIVATOR (u-PA) protease domain R37aS/V38E/Y40V/V41R/H99L/C122S/Y151L/R217V
IIGGEFTTIENQPWFAAIYRRHSGGSETVRCGGSLISPCWVISATHCFIDYPKKEDYIVYLGRSRLNSNTQGEMKFEVENLILHKDYSADTLALHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCQGDSGGPLVCSLQGRMTLTGIVSWGVGCALKDKPGVYTRVSHFLPWIRSHTKEENGLAL

SEQ ID NO: 950 - protein, 253 aa, synthetic construct
  REGION 1..253: note = UROKINASE-TYPE PLASMINOGEN ACTIVATOR (u-PA) protease domain V38E/Y40L/V41R/H99L/C122S/Y151L/R217S
IIGGEFTTIENQPWFAAIYRRHRGGSETLRCGGSLISPCWVISATHCFIDYPKKEDYIVYLGRSRLNSNTQGEMKFEVENLILHKDYSADTLALHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCQGDSGGPLVCSLQGRMTLTGIVSWGSGCALKDKPGVYTRVSHFLPWIRSHTKEENGLAL

SEQ ID NO: 951 - protein, 253 aa, synthetic construct
  REGION 1..253: note = UROKINASE-TYPE PLASMINOGEN ACTIVATOR (u-PA) protease domain R36L/V38E/Y40Q/V41R/L97bG/H99Q/C122S/Y151P/R217S
IIGGEFTTIENQPWFAAIYRLHRGGSETQRCGGSLISPCWVISATHCFIDYPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLPPEQLKMTVVKLISHRECQQPHYYGSEVTTKMLCAADPQWKTDSCQGDSGGPLVCSLQGRMTLTGIVSWGSGCALKDKPGVYTRVSHFLPWIRSHTKEENGLAL

SEQ ID NO: 952 - protein, 253 aa, synthetic construct
  REGION 1..253: note = UROKINASE-TYPE PLASMINOGEN ACTIVATOR (u-PA) protease domain R37aS/V38E/V41R/L97bG/H99Q/C122S/R217V
IIGGEFTTIENQPWFAAIYRRHSGGSETYRCGGSLISPCWVISATHCFIDYPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGVGCALKDKPGVYTRVSHFLPWIRSHTKEENGLAL

SEQ ID NO: 953 - protein, 253 aa, synthetic construct
  REGION 1..253: note = UROKINASE-TYPE PLASMINOGEN ACTIVATOR (u-PA) protease domain V38E/Y40A/V41L/L97bG/H99Q/C122S/R217T
IIGGEFTTIENQPWFAAIYRRHRGGSETALCGGSLISPCWVISATHCFIDYPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGTGCALKDKPGVYTRVSHFLPWIRSHTKEENGLAL

SEQ ID NO: 954 - protein, 253 aa, synthetic construct
  REGION 1..253: note = UROKINASE-TYPE PLASMINOGEN ACTIVATOR (u-PA) protease domain V38E/Y40H/V41Q/L97bG/H99Q/C122S/R217T
IIGGEFTTIENQPWFAAIYRRHRGGSETHQCGGSLISPCWVISATHCFIDYPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGTGCALKDKPGVYTRVSHFLPWIRSHTKEENGLAL

SEQ ID NO: 955 - protein, 253 aa, synthetic construct
  REGION 1..253: note = UROKINASE-TYPE PLASMINOGEN ACTIVATOR (u-PA) protease domain V38E/Y40H/V41T/L97bG/H99Q/C122S/R217T
IIGGEFTTIENQPWFAAIYRRHRGGSETHTCGGSLISPCWVISATHCFIDYPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGTGCALKDKPGVYTRVSHFLPWIRSHTKEENGLAL

SEQ ID NO: 956 - protein, 253 aa, synthetic construct
  REGION 1..253: note = UROKINASE-TYPE PLASMINOGEN ACTIVATOR (u-PA) protease domain V38E/Y40Q/V41L/L97bG/H99Q/C122S/Y151P/R217T
IIGGEFTTIENQPWFAAIYRRHRGGSETQLCGGSLISPCWVISATHCFIDYPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLPPEQLKMTVVKLISHRECQQPHYYGSEVTTKMLCAADPQWKTDSCQGDSGGPLVCSLQGRMTLTGIVSWGTGCALKDKPGVYTRVSHFLPWIRSHTKEENGLAL

SEQ ID NO: 957 - protein, 253 aa, synthetic construct
  REGION 1..253: note = UROKINASE-TYPE PLASMINOGEN ACTIVATOR (u-PA) protease domain V38E/Y40Q/V41L/L97bG/H99Q/C122S/R217T
IIGGEFTTIENQPWFAAIYRRHRGGSETQLCGGSLISPCWVISATHCFIDYPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGTGCALKDKPGVYTRVSHFLPWIRSHTKEENGLAL

SEQ ID NO: 958 - protein, 253 aa, synthetic construct
  REGION 1..253: note = UROKINASE-TYPE PLASMINOGEN ACTIVATOR (u-PA) protease domain R36S/V38E/Y40Q/V41R/L97bG/H99L/C122S/Y151P/R217E
IIGGEFTTIENQPWFAAIYRSHRGGSETQRCGGSLISPCWVISATHCFIDYPKKEDYIVYLGRSRLNSNTQGEMKFEVENLILHKDYSADTGALHNDIALLKIRSKEGRCAQPSRTIQTISLPSMYNDPQFGTSCEITGFGKENSTDYLPPEQLKMTVVKLISHRECQQPHYYGSEVTTKMLCAADPQWKTDSCQGDSGGPLVCSLQGRMTLTGIVSWGEGCALKDKPGVYTRVSHFLPWIRSHTKEENGLAL

SEQ ID NO: 959 - protein, 253 aa, synthetic construct
  REGION 1..253: note = UROKINASE-TYPE PLASMINOGEN ACTIVATOR (u-PA) protease domain V38E/Y40P/V41L/L97bG/H99L/C122S/Y151Q/R217E
IIGGEFTTIENQPWFAAIYRRHRGGSETPLCGGSLISPCWVISATHCFIDYPKKEDYIVYLGRSRLNSNTQGEMKFEVENLILHKDYSADTGALHNDIALLKIRSKEGRCAQPSRTIQTISLPSMYNDPQFGTSCEITGFGKENSTDYLQPEQLKMTVVKLISHRECQQPHYYGSEVTTKMLCAADPQWKTDSCQGDSGGPLVCSLQGRMTLTGIVSWGEGCALKDKPGVYTRVSHFLPWIRSHTKEENGLAL

SEQ ID NO: 960 - protein, 253 aa, synthetic construct
  REGION 1..253: note = UROKINASE-TYPE PLASMINOGEN ACTIVATOR (u-PA) protease domain R37aS/V38E/Y40H/V41T/L97bG/H99Q/C122S/R217T
IIGGEFTTIENQPWFAAIYRRHSGGSETHTCGGSLISPCWVISATHCFIDYPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGTGCALKDKPGVYTRVSHFLPWIRSHTKEENGLAL

SEQ ID NO: 961 - protein, 253 aa, synthetic construct
  REGION 1..253: note = UROKINASE-TYPE PLASMINOGEN ACTIVATOR (u-PA) protease domain R37aS/V38E/Y40P/V41L/L97bG/H99Q/C122S/Y151Q/R217T
IIGGEFTTIENQPWFAAIYRRHSGGSETPLCGGSLISPCWVISATHCFIDYPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLQPEQLKMTVVKLISHRECQQPHYYGSEVTTKMLCAADPQWKTDSCQGDSGGPLVCSLQGRMTLTGIVSWGTGCALKDKPGVYTRVSHFLPWIRSHTKEENGLAL

SEQ ID NO: 962 - protein, 253 aa, synthetic construct
  REGION 1..253: note = UROKINASE-TYPE PLASMINOGEN ACTIVATOR (u-PA) protease domain R37aS/V38E/Y40Q/V41L/L97bG/C122S/Y151P/R217T
IIGGEFTTIENQPWFAAIYRRHSGGSETQLCGGSLISPCWVISATHCFIDYPKKEDYIVYLGRSRLNSNTQGEMKFEVENLILHKDYSADTGAHHNDIALLKIRSKEGRCAQPSRTIQTISLPSMYNDPQFGTSCEITGFGKENSTDYLPPEQLKMTVVKLISHRECQQPHYYGSEVTTKMLCAADPQWKTDSCQGDSGGPLVCSLQGRMTLTGIVSWGTGCALKDKPGVYTRVSHFLPWIRSHTKEENGLAL

SEQ ID NO: 963 - protein, 253 aa, synthetic construct
  REGION 1..253: note = UROKINASE-TYPE PLASMINOGEN ACTIVATOR (u-PA) protease domain R36S/V38E/Y40L/V41N/L97bG/H99Q/C122S/Y151L/R217T
IIGGEFTTIENQPWFAAIYRSHRGGSETLNCGGSLISPCWVISATHCFIDYPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCQGDSGGPLVCSLQGRMTLTGIVSWGTGCALKDKPGVYTRVSHFLPWIRSHTKEENGLAL

SEQ ID NO: 964 - protein, 253 aa, synthetic construct
  REGION 1..253: note = UROKINASE-TYPE PLASMINOGEN ACTIVATOR (u-PA) protease domain R35S/V38E/L97bR/C122S/Y151L/R217V/H241N
IIGGEFTTIENQPWFAAIYSRHRGGSETYVCGGSLISPCWVISATHCFIDYPKKEDYIVYLGRSRLNSNTQGEMKFEVENLILHKDYSADTRAHHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCQGDSGGPLVCSLQGRMTLTGIVSWGVGCALKDKPGVYTRVSHFLPWIRSNTKEENGLAL

SEQ ID NO: 965 - protein, 253 aa, synthetic construct
  REGION 1..253: note = UROKINASE-TYPE PLASMINOGEN ACTIVATOR (u-PA) protease domain R35S/V38E/H99Q/C122S/S146F/Y151L/V159L/K179N/Q192R /R217V/T242S
IIGGEFTTIENQPWFAAIYSRHRGGSETYVCGGSLISPCWVISATHCFIDYPKKEDYIVYLGRSRLNSNTQGEMKFEVENLILHKDYSADTLAQHNDIALLKIRSKEGRCAQPSRTIQTISLPSMYNDPQFGTSCEITGFGKENFTDYLLPEQLKMTLVKLISHRECQQPHYYGSEVTTNMLCAADPQWKTDSCRGDSGGPLVCSLQGRMTLTGIVSWGVGCALKDKPGVYTRVSHFLPWIRSHSKEENGLAL

SEQ ID NO: 966 - protein, 253 aa, synthetic construct
  REGION 1..253: note = UROKINASE-TYPE PLASMINOGEN ACTIVATOR (u-PA) protease domain F30Y/R37aH/V38E/H99Q/C122S/Y151L/R217V
IIGGEFTTIENQPWYAAIYRRHHGGSETYVCGGSLISPCWVISATHCFIDYPKKEDYIVYLGRSRLNSNTQGEMKFEVENLILHKDYSADTLAQHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCQGDSGGPLVCSLQGRMTLTGIVSWGVGCALKDKPGVYTRVSHFLPWIRSHTKEENGLAL

SEQ ID NO: 967 - protein, 253 aa, synthetic construct
  REGION 1..253: note = UROKINASE-TYPE PLASMINOGEN ACTIVATOR (u-PA) protease domain R35H/V38E/L97bR/C122S/Y151L/R217V
IIGGEFTTIENQPWFAAIYHRHRGGSETYVCGGSLISPCWVISATHCFIDYPKKEDYIVYLGRSRLNSNTQGEMKFEVENLILHKDYSADTRAHHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCQGDSGGPLVCSLQGRMTLTGIVSWGVGCALKDKPGVYTRVSHFLPWIRSHTKEENGLAL

SEQ ID NO: 968 - protein, 253 aa, synthetic construct
  REGION 1..253: note = UROKINASE-TYPE PLASMINOGEN ACTIVATOR (u-PA) protease domain V38E/T56I/H99Q/C122S/Y151L/S190G/R217V
IIGGEFTTIENQPWFAAIYRRHRGGSETYVCGGSLISPCWVISAIHCFIDYPKKEDYIVYLGRSRLNSNTQGEMKFEVENLILHKDYSADTLAQHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDGCQGDSGGPLVCSLQGRMTLTGIVSWGVGCALKDKPGVYTRVSHFLPWIRSHTKEENGLAL

SEQ ID NO: 969 - protein, 253 aa, synthetic construct
  REGION 1..253: note = UROKINASE-TYPE PLASMINOGEN ACTIVATOR (u-PA) protease domain F30Y/V38E/L97bR/C122S/Y151L/R217V
IIGGEFTTIENQPWYAAIYRRHRGGSETYVCGGSLISPCWVISATHCFIDYPKKEDYIVYLGRSRLNSNTQGEMKFEVENLILHKDYSADTRAHHNDIALLKIRSKEGRCAQPSRTIQTISLPSMYNDPQFGTSCEITGFGKENSTDYLLPEQLKMTVVKLISHRECQQPHYYGSEVTTKMLCAADPQWKTDSCQGDSGGPLVCSLQGRMTLTGIVSWGVGCALKDKPGVYTRVSHFLPWIRSHTKEENGLAL

SEQ ID NO: 970 - protein, 253 aa, synthetic construct
  REGION 1..253: note = UROKINASE-TYPE PLASMINOGEN ACTIVATOR (u-PA) protease domain V38E/T39S/V41L/Y60bP/L97bG/H99Q/C122S
IIGGEFTTIENQPWFAAIYRRHRGGSESYLCGGSLISPCWVISATHCFIDPPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 971 - protein, 253 aa, synthetic construct
  REGION 1..253: note = UROKINASE-TYPE PLASMINOGEN ACTIVATOR (u-PA) protease domain V38E/T39R/D60aP/Y60bD/L97bG/H99Q/C122S
IIGGEFTTIENQPWFAAIYRRHRGGSERYVCGGSLISPCWVISATHCFIPDPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 972 - protein, 253 aa, synthetic construct
  REGION 1..253: note = UROKINASE-TYPE PLASMINOGEN ACTIVATOR (u-PA) protease domain V38E/T39W/V41R/D60aP/Y60bD/L97bA/H99L/C122S
IIGGEFTTIENQPWFAAIYRRHRGGSEWYRCGGSLISPCWVISATHCFIPDPKKEDYIVYLGRSRLNSNTQGEMKFEVENLILHKDYSADTAALHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 973 - protein, 253 aa, synthetic construct
  REGION 1..253: note = UROKINASE-TYPE PLASMINOGEN ACTIVATOR (u-PA) protease domain V38E/T39Y/V41R/D60aW/Y60bP/L97bR/H99I/C122S
IIGGEFTTIENQPWFAAIYRRHRGGSEYYRCGGSLISPCWVISATHCFIWPPKKEDYIVYLGRSRLNSNTQGEMKFEVENLILHKDYSADTRAIHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 974 - protein, 253 aa, synthetic construct
  REGION 1..253: note = UROKINASE-TYPE PLASMINOGEN ACTIVATOR (u-PA) protease domain V38E/T39H/D60aP/Y60bK/L97bG/H99Q/C122S
IIGGEFTTIENQPWFAAIYRRHRGGSEHYVCGGSLISPCWVISATHCFIPKPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 975 - protein, 253 aa, synthetic construct
  REGION 1..253: note = UROKINASE-TYPE PLASMINOGEN ACTIVATOR (u-PA) protease domain V38E/T39L/V41R/D60aN/Y60bP/L97bG/H99Q/C122S
IIGGEFTTIENQPWFAAIYRRHRGGSELYRCGGSLISPCWVISATHCFINPPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 976 - protein, 253 aa, synthetic construct
  REGION 1..253: note = UROKINASE-TYPE PLASMINOGEN ACTIVATOR (u-PA) protease domain V38E/T39H/D60aP/Y60bW/L97bG/H99Q/C122S
IIGGEFTTIENQPWFAAIYRRHRGGSEHYVCGGSLISPCWVISATHCFIPWPKKEDYIVYLGRSRLNSNTQGEMKFEVENLILHKDYSADTGAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 977 - protein, 253 aa, synthetic construct
  REGION 1..253: note = UROKINASE-TYPE PLASMINOGEN ACTIVATOR (u-PA) protease domain V38E/T39W/V41R/D60aW/Y60bP/L97bG/H99L/C122S
IIGGEFTTIENQPWFAAIYRRHRGGSEWYRCGGSLISPCWVISATHCFIWPPKKEDYIVYLGRSRLNSNTQGEMKFEVENLILHKDYSADTGALHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 978 - protein, 253 aa, synthetic construct
  REGION 1..253: note = UROKINASE-TYPE PLASMINOGEN ACTIVATOR (u-PA) protease domain R35H/V38E/T39Y/V41R/D60aP/Y60bQ/L97bA/H99Q/C122S/I 138V/E167K
IIGGEFTTIENQPWFAAIYHRHRGGSEYYRCGGSLISPCWVISATHCFIPQPKKEDYIVYLGRSRLNSNTQGEMKFEVENLILHKDYSADTAAQHNDIALLKIRSKEGRCAQPSRTIQTISLPSMYNDPQFGTSCEVTGFGKENSTDYLYPEQLKMTVVKLISHRKCQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 979 - protein, 253 aa, synthetic construct
  REGION 1..253: note = UROKINASE-TYPE PLASMINOGEN ACTIVATOR (u-PA) protease domain R35H/V38E/T39Y/V41R/D60aP/Y60bQ/L97bA/H99Q/C122S/T 158S/E167K
IIGGEFTTIENQPWFAAIYHRHRGGSEYYRCGGSLISPCWVISATHCFIPQPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKMSVVKLISHRKCQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 980 - protein, 253 aa, synthetic construct
  REGION 1..253: note = UROKINASE-TYPE PLASMINOGEN ACTIVATOR (u-PA) protease domain R35H/G37bD/V38E/T39Y/V41R/D60aP/Y60bQ/L97bA/H99Q/C 122S/T158S
IIGGEFTTIENQPWFAAIYHRHRDGSEYYRCGGSLISPCWVISATHCFIPQPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKMSVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 981 - protein, 253 aa, synthetic construct
  REGION 1..253: note = UROKINASE-TYPE PLASMINOGEN ACTIVATOR (u-PA) protease domain R35H/V38E/T39Y/V41R/D60aP/Y60bQ/L97bA/H99Q/C122S/T 158A
IIGGEFTTIENQPWFAAIYHRHRGGSEYYRCGGSLISPCWVISATHCFIPQPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKMAVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 982 - protein, 253 aa, synthetic construct
  REGION 1..253: note = UROKINASE-TYPE PLASMINOGEN ACTIVATOR (u-PA) protease domain R35H/V38E/T39Y/V41R/T56A/D60aP/Y60bQ/L97bA/H99Q/C1 22S
IIGGEFTTIENQPWFAAIYHRHRGGSEYYRCGGSLISPCWVISAAHCFIPQPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 983 - protein, 253 aa, synthetic construct
  REGION 1..253: note = UROKINASE-TYPE PLASMINOGEN ACTIVATOR (u-PA) protease domain R35H/V38E/T39Y/V41R/T56S/D60aP/Y60bQ/L97bA/H99Q/C1 22S/T158S
IIGGEFTTIENQPWFAAIYHRHRGGSEYYRCGGSLISPCWVISASHCFIPQPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKMSVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 984 - protein, 253 aa, synthetic construct
  REGION 1..253: note = UROKINASE-TYPE PLASMINOGEN ACTIVATOR (u-PA) protease domain R37aH/V38E/T39Y/V41R/T56A/D60aP/Y60bQ/L97bA/H99Q/C 122S/T158A
IIGGEFTTIENQPWFAAIYRRHHGGSEYYRCGGSLISPCWVISAAHCFIPQPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKMAVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 985 - protein, 253 aa, synthetic construct
  REGION 1..253: note = UROKINASE-TYPE PLASMINOGEN ACTIVATOR (u-PA) protease domain R37aH/V38E/T39Y/V41R/D60aP/Y60bQ/L97bA/H99Q/C122S
IIGGEFTTIENQPWFAAIYRRHHGGSEYYRCGGSLISPCWVISATHCFIPQPKKEDYIVYLGRSRLNSNTQGEMKFEVENLILHKDYSADTAAQHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 986 - protein, 253 aa, synthetic construct
  REGION 1..253: note = UROKINASE-TYPE PLASMINOGEN ACTIVATOR (u-PA) protease domain R35H/V38E/T39Y/V41R/D60aP/Y60bQ/P60cS/L97bA/H99Q/C 122S/I138V/E167K
IIGGEFTTIENQPWFAAIYHRHRGGSEYYRCGGSLISPCWVISATHCFIPQSKKEDYIVYLGRSRLNSNTQGEMKFEVENLILHKDYSADTAAQHNDIALLKIRSKEGRCAQPSRTIQTISLPSMYNDPQFGTSCEVTGFGKENSTDYLYPEQLKMTVVKLISHRKCQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 987 - protein, 253 aa, synthetic construct
  REGION 1..253: note = UROKINASE-TYPE PLASMINOGEN ACTIVATOR (u-PA) protease domain R35Q/H37Y/R37aE/V38E/T39Y/V41R/D60aP/Y60bQ/T97aI/L 97bA/C122C/H99Q/Y149R
IIGGEFTTIENQPWFAAIYQRYEGGSEYYRCGGSLISPCWVISATHCFIPQPKKEDYIVYLGRSRLNSNTQGEMKFEVENLILHKDYSADIAAQHNDIALLKIRSKEGRCAQPSRTIQTICLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 988 - DNA, 6418 bp, synthetic construct
  misc_feature 1..6418: note = pE5 plasmid
  source 1..6418: mol_type = other DNA
gatctcgatcccgcgaaattaatacgactcactataggggaattgtgagcggataacaattcccctctagtaataattttgtttaactttaagaaggaggtctagaatgggtcatcatcaccatcatcatggtagcctgcaggatagcgaagttaatcaagaagcaaaaccggaagttaagccggaagtgaaacctgaaacacatattaacctgaaagtgagtgatggcagcagcgaaatcttcttcaaaatcaaaaaaaccacaccgctgcgtcgtctgatggaagcatttgcaaaacgtcagggtaaagaaatggatagcctgcgttttctgtatgatggtattcgtattcaggcagatcaggcaccggaagatctggatatggaagataacgatattatcgaagcacatcgtgagcagattggtggtgttgttggtggcaccgatgcagatgaaggtgaatggccgtggcaggttagcctgcatgcattaggtcatggtcatagctgtggtgcaagcctgattagcccgaattggctggttagcgcagcacattgttatattgatacccgtggtagccgttggagcgatccgacacagtggaccgcatttctgggtctgcatgatcagagccagcgtagcgcaccgggtgttcaagaacgtcgcctgaaacgtattattagccatccgttttttaataaaggtgtgccgctggattatgatattgcactgctggaactggaaaaaccggcagaatatagcagcatggttcgtccgatttgtctgccggatgcaagccatgtttttccggcaggtaaagcaatttgggttaccggttggggtcatacccagtatggtggtacacatgcactgatcctgcagaaaggtgaaattcgtgttattaatcagaccacgtgtgaaaatctgctgccgcagctgattacaccgcgtatgatgtgtgttggttttctgagcggtggtgtggatagctgtgatggcgatagcggtggtccgctgagcagcgttgaagcagatggtcgtatttttcaggcaggcgttgttagctggggtgatggttgtgcacagcgtaataaaccgggtgtgtatacccgtctgccgctgtttcgtgattggattaaagaaaataccggtgtgtaataactcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcaatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcga

SEQ ID NO: 989 - protein, 6 aa, synthetic construct
  REGION 1..6: note = HIS tag
HHHHHH

SEQ ID NO: 990 - protein, 108 aa, synthetic construct
  REGION 1..108: note = HIS tag-SUMO
MGHHHHHHGSLQDSEVNQEAKPEVKPEVKPETHINLKVSDGSSEIFFKIKKTTPLRRLMEAFAKRQGKEMDSLRFLYDGIRIQADQAPEDLDMEDNDIIEAHREQIGG

SEQ ID NO: 991 - protein, 585 aa, Homo sapiens [sequence omitted]

SEQ ID NO: 992 - protein, 226 aa, Homo sapiens
  REGION 1..226: note = Immunoglobulin Gamma-1 heavy chain (FC)
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 993 - protein, 248 aa, synthetic construct
  REGION 1..248: note = Anti-Type-II collagen Antibody scFv Fragment
QVQLQQPGADLVRPGVSVKLSCKASGYTFTSYWMNWVKQRPGQGLEWIGMIHPSDSETRLSQKFKDKATLTVDKSSSTAYMQLSSPTSEDSAVYYCARLKPGGTWFAYWGQGTLVTVSAGGGGSGGGGSGGGGSGGSDIVLTQSPASLTVSLGQRATISCRASKSVDSYGNSFMEWYQQKPGQPPKLLIYRASNLESGIPARFSGSGSRTDFTLTINPVEADDVATYYCQQSNEDPYTFGGGTKLEIK

SEQ ID NO: 994 - protein, 103 aa, synthetic construct
  REGION 1..103: note = human Tumor necrosis factor-stimulated gene-6 (TSG-6) aa residues 32-134 (HABP)
ERAAGVYHREARSGKYKLTYAEAKAVCEFEGGHLATYKQLEAARKIGFHVCAAGWMAKGRVGYPIVKPGPNCGFGKTGIIDYGIRLNRSERWDAYCYNPHAKE

SEQ ID NO: 995 - protein, 12 aa, synthetic construct
  REGION 1..12: note = Furin activation sequence
QCGQKTLRRRKR

SEQ ID NO: 996 - protein, 12 aa, synthetic construct
  REGION 1..12: note = Furin activation sequence
QSGQKTLRRRKR

SEQ ID NO: 997 - protein, 12 aa, synthetic construct
  REGION 1..12: note = UROKINASE-TYPE PLASMINOGEN ACTIVATOR (u-PA) activation sequence
QCGQKTLRPRFK

SEQ ID NO: 998 - protein, 12 aa, synthetic construct
  REGION 1..12: note = UROKINASE-TYPE PLASMINOGEN ACTIVATOR (u-PA) activation sequence
QSGQKTLRPRFK

SEQ ID NO: 999 - protein, 20 aa, Mus musculus
  REGION 1..20: note = Ig kappa chain V-III region signal peptide (IgGkSP)
METDTLLLWVLLLWVPGSTG

SEQ ID NO: 1000 - protein, 20 aa, Homo sapiens
  REGION 1..20: note = human IL2 Signal Peptide (hIL2SP)
MYRMQLLSCIALSLALVTNS

SEQ ID NO: 1001 - protein, 5 aa, synthetic construct
  REGION 1..5: note = GGGGS linker
GGGGS

SEQ ID NO: 1002 - protein, 6 aa, synthetic construct
  REGION 1..6: note = GGSSGG linker
GGSSGG

SEQ ID NO: 1003 - skipped

SEQ ID NO: 1004 - protein, 514 aa, synthetic construct
  REGION 1..514: note = IgGkSP-FC-AGS-uPA R35Q/H37Y/R37aE/V38E/T39Y/V41R/D60aP/Y60bQ/T97aI/L 97bA/H99Q/Y149R fusion
METDTLLLWVLLLWVPGSTGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAGSQCGQKTLRPRFKIIGGEFTTIENQPWFAAIYQRYEGGSEYYRCGGSLISPCWVISATHCFIPQPKKEDYIVYLGRSRLNSNTQGEMKFEVENLILHKDYSADIAAQHNDIALLKIRSKEGRCAQPSRTIQTICLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 1005 - protein, 431 aa, synthetic construct
  REGION 1..431: note = IgGkSP-uPA R35Q/H37Y/R37aE/V38E/T39Y/V41R/D60aP/Y60bQ/T97aI/L 97bA/H99Q/Y149R
METDTLLLWVLLLWVPGSTGSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWFAAIYQRYEGGSEYYRCGGSLISPCWVISATHCFIPQPKKEDYIVYLGRSRLNSNTQGEMKFEVENLILHKDYSADIAAQHNDIALLKIRSKEGRCAQPSRTIQTICLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 1006 - protein, 505 aa, synthetic construct
  REGION 1..505: note = hIL2ss-uPA R35Q/H37Y/R37aE/V38E/T39Y/V41R/D60aP/Y60bQ/T97aI/L 97bA/H99Q/C122S/Y149R-IgG1Fc
MYRMQLLSCIALSLALVTNSIIGGEFTTIENQPWFAAIYQRYEGGSEYYRCGGSLISPCWVISATHCFIPQPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLALGGSSGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1007 - protein, 864 aa, synthetic construct
  REGION 1..864: note = hIL2ss-uPA R35Q/H37Y/R37aE/V38E/T39Y/V41R/D60aP/Y60bQ/T97aI/L 97bA/H99Q/C122S/Y149R-HSA
MYRMQLLSCIALSLALVTNSIIGGEFTTIENQPWFAAIYQRYEGGSEYYRCGGSLISPCWVISATHCFIPQPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLALGGSSGGDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 1008 - protein, 864 aa, synthetic construct; identical to SEQ ID NO: 1007
  REGION 1..864: note = hIL2ss-uPA R35Q/H37Y/R37aE/V38E/T39Y/V41R/D60aP/Y60bQ/T97aI/L 97bA/H99Q/C122S/Y149R-C2scFv

SEQ ID NO: 1009 - protein, 382 aa, synthetic construct
  REGION 1..382: note = hIL2ss-uPA R35Q/H37Y/R37aE/V38E/T39Y/V41R/D60aP/Y60bQ/T97aI/L 97bA/H99Q/C122S/Y149R-HABD
MYRMQLLSCIALSLALVTNSIIGGEFTTIENQPWFAAIYQRYEGGSEYYRCGGSLISPCWVISATHCFIPQPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLALGGSSGGERAAGVYHREARSGKYKLTYAEAKAVCEFEGGHLATYKQLEAARKIGFHVCAAGWMAKGRVGYPIVKPGPNCGFGKTGIIDYGIRLNRSERWDAYCYNPHAKE

SEQ ID NO: 1010 - protein, 516 aa, synthetic construct
  REGION 1..516: note = IgGkSP-Furin-uPA R35Q/H37Y/R37aE/V38E/T39Y/V41R/D60aP/Y60bQ/T97aI/L 97bA/H99Q/C122S/Y149R-FC
METDTLLLWVLLLWVPGSTGQSGQKTLRRKRIIGGEFTTIENQPWFAAIYQRYEGGSEYYRCGGSLISPCWVISATHCFIPQPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLALGGSSGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1011 - protein, 663 aa, synthetic construct
  REGION 1..663: note = IgGkSP-uPA R35Q/H37Y/R37aE/V38E/T39Y/V41R/D60aP/Y60bQ/T97aI/L 97bA/H99Q/Y149R-FC
METDTLLLWVLLLWVPGSTGSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWFAAIYQRYEGGSEYYRCGGSLISPCWVISATHCFIPQPKKEDYIVYLGRSRLNSNTQGEMKFEVENLILHKDYSADIAAQHNDIALLKIRSKEGRCAQPSRTIQTICLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLALGGSSGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1012 - protein, 505 aa, synthetic construct
  REGION 1..505: note = hIL2ss-uPA -FC
MYRMQLLSCIALSLALVTNSIIGGEFTTIENQPWFAAIYRRHRGGSVTYVCGGSLMSPCWVISATHCFIDYPKKEDYIVYLGRSRLNSNTQGEMKFEVENLILHKDYSADTLAHHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLALGGSSGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1013 - protein, 864 aa, synthetic construct
  REGION 1..864: note = hIL2ss-uPA -HSA
MYRMQLLSCIALSLALVTNSIIGGEFTTIENQPWFAAIYRRHRGGSVTYVCGGSLMSPCWVISATHCFIDYPKKEDYIVYLGRSRLNSNTQGEMKFEVENLILHKDYSADTLAHHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLALGGSSGGDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 1014 - protein, 1022 aa, synthetic construct
  REGION 1..1022: note = IgGkSP-Furin-u-PA R35Q/H37Y/R37aE/V38E/T39Y/V41R/D60aP/Y60bQ/T97aI/L 97bA/H99Q/Y149R-HSA
METDTLLLWVLLLWVPGSTGSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRRRKRIIGGEFTTIENQPWFAAIYQRYEGGSEYYRCGGSLISPCWVISATHCFIPQPKKEDYIVYLGRSRLNSNTQGEMKFEVENLILHKDYSADIAAQHNDIALLKIRSKEGRCAQPSRTIQTICLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLALGGSSGGDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 1015 - protein, 1022 aa, synthetic construct
  REGION 1..1022: note = IgGkSP-u-PA activation-u-PA R35Q/H37Y/R37aE/V38E/T39Y/V41R/D60aP/Y60bQ/T97aI/L 97bA/H99Q/Y149R-HSA
METDTLLLWVLLLWVPGSTGSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWFAAIYQRYEGGSEYYRCGGSLISPCWVISATHCFIPQPKKEDYIVYLGRSRLNSNTQGEMKFEVENLILHKDYSADIAAQHNDIALLKIRSKEGRCAQPSRTIQTICLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLALGGSSGGDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 1016 - protein, 876 aa, synthetic construct
  REGION 1..876: note = IgGkSP-furin activation-uPA R35Q/H37Y/R37aE/V38E/T39Y/V41R/D60aP/Y60bQ/T97aI/L 97bA/H99Q/C122S/Y149R-linker-HSA
METDTLLLWVLLLWVPGSTGQSGQKTLRRRKRIIGGEFTTIENQPWFAAIYQRYEGGSEYYRCGGSLISPCWVISATHCFIPQPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLALGGSSGGDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 1017 - protein, 972 aa, synthetic construct
  REGION 1..972: note = IgGkSS-HIS-SUMO-uPA R35Q/H37Y/R37aE/V38E/T39Y/V41R/D60aP/Y60bQ/T97aI/L 97bA/H99Q/C122S/Y149R-linker-HSA
METDTLLLWVLLLWVPGSTGDGHHHHHHGSLQDSEVNQEAKPEVKPEVKPETHINLKVSDGSSEIFFKIKKTTPLRRLMEAFAKRQGKEMDSLTFLYDGIEIQADQTPEDLDMEDNDIIEAHREQIGGIIGGEFTTIENQPWFAAIYQRYEGGSEYYRCGGSLISPCWVISATHCFIPQPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLALGGSSGGDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 1018 - protein, 613 aa, synthetic construct
  REGION 1..613: note = IgGkSS-HIS-SUMO-uPA R35Q/H37Y/R37aE/V38E/T39Y/V41R/D60aP/Y60bQ/T97aI/L 97bA/H99Q/C122S/Y149R-linker-FC
METDTLLLWVLLLWVPGSTGDGHHHHHHGSLQDSEVNQEAKPEVKPEVKPETHINLKVSDGSSEIFFKIKKTTPLRRLMEAFAKRQGKEMDSLTFLYDGIEIQADQTPEDLDMEDNDIIEAHREQIGGIIGGEFTTIENQPWFAAIYQRYEGGSEYYRCGGSLISPCWVISATHCFIPQPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLALGGSSGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1019 - protein, 1002 aa, synthetic construct
  REGION 1..1002: note = uPA N-term-uPA activation-u-PA R35Q/H37Y/R37aE/V38E/T39Y/V41R/D60aP/Y60bQ/T97aI/L 97bA/H99Q/Y149R-HSA
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWFAAIYQRYEGGSEYYRCGGSLISPCWVISATHCFIPQPKKEDYIVYLGRSRLNSNTQGEMKFEVENLILHKDYSADIAAQHNDIALLKIRSKEGRCAQPSRTIQTICLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLALGGSSGGDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 1020 - protein, 326 aa, Homo sapiens
  REGION 1..326: note = hIgG2 heavy chain constant
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1021 - protein, 377 aa, Homo sapiens
  REGION 1..377: note = hIgG3 heavy chain constant
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 1022 - protein, 327 aa, Homo sapiens
  REGION 1..327: note = hIgG4 heavy chain constant
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1023 - protein, 227 aa, Homo sapiens
  REGION 1..227: note = Immunoglobulin Gamma-1 heavy chain (FC)
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1024 - protein, 5 aa, synthetic construct
  REGION 1..5: note = SSSSG linker
SSSSG

SEQ ID NO: 1025 - protein, 12 aa, synthetic construct
  REGION 1..12: note = GKSSGSGSESKS linker
GKSSGSGSESKS

SEQ ID NO: 1026 - protein, 15 aa, synthetic construct
  REGION 1..15: note = GGSTSGSGKSSEGKG linker
GGSTSGSGKSSEGKG

SEQ ID NO: 1027 - protein, 19 aa, synthetic construct
  REGION 1..19: note = GSTSGSGKSSSEGSGSTKG linker
GSTSGSGKSSSEGSGSTKG

SEQ ID NO: 1028 - protein, 18 aa, synthetic construct
  REGION 1..18: note = GSTSGSGKPGSGEGSTKG linker
GSTSGSGKPGSGEGSTKG

SEQ ID NO: 1029 - protein, 14 aa, synthetic construct
  REGION 1..14: note = EGKSSGSGSESKEF linker
EGKSSGSGSESKEF

SEQ ID NO: 1030 - protein, 4 aa, synthetic construct
  REGION 1..4: note = AAPA linker
AAPA

SEQ ID NO: 1031 - protein, 100 aa, synthetic construct
  REGION 1..100: note = SUMO
GSLQDSEVNQEAKPEVKPEVKPETHINLKVSDGSSEIFFKIKKTTPLRRLMEAFAKRQGKEMDSLRFLYDGIRIQADQAPEDLDMEDNDIIEAHREQIGG

SEQ ID NO: 1032 - protein, 108 aa, synthetic construct
  REGION 1..108: note = DG-6xHIS-SUMO
DGHHHHHHGSLQDSEVNQEAKPEVKPEVKPETHINLKVSDGSSEIFFKIKKTTPLRRLMEAFAKRQGKEMDSLTFLYDGIEIQADQTPEDLDMEDNDIIEAHREQIGG

SEQ ID NO: 1033 - protein, 100 aa, synthetic construct
  REGION 1..100: note = SUMO
GSLQDSEVNQEAKPEVKPEVKPETHINLKVSDGSSEIFFKIKKTTPLRRLMEAFAKRQGKEMDSLTFLYDGIEIQADQTPEDLDMEDNDIIEAHREQIGG

SEQ ID NO: 1034 - protein, 505 aa, synthetic construct
  REGION 1..505: note = hIL2ss-uPA -FC
MYRMQLLSCIALSLALVTNSIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLALGGSSGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1035 - protein, 867 aa, synthetic construct
  REGION 1..867: note = hIL2ss-uPA -HSA
MYRMQLLSCIALSLALVTNSIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTISLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLALGGSSGGDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLSPG

SEQ ID NO: 1036 - protein, 663 aa, synthetic construct
  REGION 1..663: note = IgGkSP-uPA N-term-furin activation-u-PA R35Q/H37Y/R37aE/V38E/T39Y/V41R/D60aP/Y60bQ/T97aI/L 97bA/H99Q/Y149R-linker-Fc
METDTLLLWVLLLWVPGSTGSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRRRKRIIGGEFTTIENQPWFAAIYQRYEGGSEYYRCGGSLISPCWVISATHCFIPQPKKEDYIVYLGRSRLNSNTQGEMKFEVENLILHKDYSADIAAQHNDIALLKIRSKEGRCAQPSRTIQTICLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLALGGSSGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1037 - protein, 361 aa, synthetic construct
  REGION 1..361: note = HHHHHH-SUMO-uPA R35Q/H37Y/R37aE/V38E/T39Y/V41R/D60aP/Y60bQ/T97aI/L 97bA/H99Q/Y149R
MGHHHHHHGSLQDSEVNQEAKPEVKPEVKPETHINLKVSDGSSEIFFKIKKTTPLRRLMEAFAKRQGKEMDSLRFLYDGIRIQADQAPEDLDMEDNDIIEAHREQIGGIIGGEFTTIENQPWFAAIYQRYEGGSEYYRCGGSLISPCWVISATHCFIPQPKKEDYIVYLGRSRLNSNTQGEMKFEVENLILHKDYSADIAAQHNDIALLKIRSKEGRCAQPSRTIQTICLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 1038 - protein, 361 aa, synthetic construct
  REGION 1..361: note = HHHHHH-SUMO-uPA R35Q/H37Y/R37aE/V38E/T39Y/V41R/D60aP/Y60bQ/T97aI/L 97bA/H99Q/C122S/Y149R
MGHHHHHHGSLQDSEVNQEAKPEVKPEVKPETHINLKVSDGSSEIFFKIKKTTPLRRLMEAFAKRQGKEMDSLRFLYDGIRIQADQAPEDLDMEDNDIIEAHREQIGGIIGGEFTTIENQPWFAAIYQRYEGGSEYYRCGGSLISPCWVISATHCFIPQPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 1039 - protein, 366 aa, synthetic construct
  REGION 1..366: note = HHHHHH-SUMO-uPA R35Q/H37Y/R37aE/V38E/T39Y/V41R/D60aP/Y60bQ/T97aI/L 97bA/H99Q/C122S/Y149R-GGSCK
MGHHHHHHGSLQDSEVNQEAKPEVKPEVKPETHINLKVSDGSSEIFFKIKKTTPLRRLMEAFAKRQGKEMDSLRFLYDGIRIQADQAPEDLDMEDNDIIEAHREQIGGIIGGEFTTIENQPWFAAIYQRYEGGSEYYRCGGSLISPCWVISATHCFIPQPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLALGGSCK

SEQ ID NO: 1040 - protein, 875 aa, synthetic construct
  REGION 1..875: note = IgGkSP-furin activation-uPA R35Q/H37Y/R37aE/V38E/T39Y/V41R/D60aP/Y60bQ/T97aI/L 97bA/H99Q/C122S/Y149R-linker-HSA
METDTLLLWVLLLWVPGSTGQSGQKTLRRKRIIGGEFTTIENQPWFAAIYQRYEGGSEYYRCGGSLISPCWVISATHCFIPQPKKEDYIVYLGRSRLNSNTQGEMKFEVENLILHKDYSADIAAQHNDIALLKIRSKEGRCAQPSRTIQTISLPSMYNDPQFGTSCEITGFGKENSTDRLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLALGGSSGGDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 1041 - protein, 10 aa, synthetic construct
  REGION 1..10: note = Furin activation sequence
QSGKTLRRKR

SEQ ID NO: 1042 - protein, 146 aa, Synthetic construct
  source 1..146: note = uPA N-terminus
SNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKF

SEQ ID NO: 1043 - protein, 255 aa, synthetic construct
  REGION 1..255: note = Chain A, IG GAMMA-1 CHAIN C REGION
MKKTAIAIAVALAGFATVAQADVESKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1044 - protein, 11 aa, synthetic construct
  REGION 1..11: note = Furin
QSGQKTLRRKR

What is claimed:

1. A nucleic acid molecule, comprising a sequence of nucleotides encoding a modified urokinase-type plasminogen activator (u-PA) polypeptide that comprises one or more amino acid modifications selected from among replacements corresponding to R35Q, R35W, R35Y, H37E, H37Y, V41R, Y40Q, D60aP, L97bA, L97bG, T97aI, H99Q, and conservative amino acid modifications therefor, whereby the modified u-PA polypeptide has increased activity and/or specificity for a complement protein compared to the unmodified active form of the u-PA polypeptide, wherein:

any further amino acid modifications in the encoded modified u-PA polypeptide are selected from among replacements, insertions and deletions in the primary sequence of the modified u-PA polypeptide;

the encoded modified u-PA polypeptide cleaves a complement protein to thereby inhibit or reduce complement activation compared to the unmodified u-PA polypeptide that does not contain the amino acid modifications;
the complement protein is C3;
the encoded modified u-PA polypeptide has reduced activity or specificity for cleavage of a substrate sequence in plasminogen compared to the unmodified u-PA polypeptide;
the encoded modified u-PA polypeptide has at least 90% sequence identity with the polypeptides of any of SEQ ID NOs: 1-6 or a catalytically active portion thereof;
the residues are numbered by chymotrypsin numbering;
the unmodified u-PA polypeptide comprises the sequence set forth in any of SEQ ID NOs: 1-6, or a catalytically active fragment thereof that includes the amino acid modification position(s); and
the conservative modifications are selected from among R35F or N; H37R, Q, W or F; V41K; D60aS; T97aL or V; L97bS; and H99N.

2. The nucleic acid molecule of claim 1, wherein the encoded modified u-PA polypeptide cleaves within residues QHARASHLG (residues 737-745) of human C3 (SEQ ID NO: 47).

3. The nucleic acid molecule of claim 1, wherein the encoded modified u-PA polypeptide has increased activity for cleavage of C3 that is least 3-fold greater than the unmodified u-PA polypeptide comprising the protease domain of SEQ ID NO: 5, or a corresponding form of u-PA set forth in any of SEQ ID NOs: 1-4 and 6.

4. The nucleic acid molecule of claim 1, wherein:
the encoded modified u-PA polypeptide has an ED50 for inactivation cleavage of C3 of less than 100 nM in an in vitro assay; and
the modified u-PA polypeptide has stability of greater than 50% after incubation in PBS, or a body fluid for 7 days.

5. The nucleic acid molecule of claim 1, wherein the unmodified u-PA polypeptide consists of the sequence of amino acids set forth in any of SEQ ID NOs: 1-6.

6. The nucleic acid molecule of claim 1, wherein the encoded modified u-PA polypeptide comprises up to 20 amino acid replacements, insertions, and/or deletions, compared to the unmodified u-PA polypeptide of any of SEQ ID NOs: 1-6 or a catalytically active portion thereof.

7. The nucleic acid molecule of claim 1, wherein the encoded modified u-PA polypeptide comprises one or more amino acid modifications selected from among replacements corresponding to R35Q, H37Y, V41R, Y40Q, D60aP, L97bA, T97aI, and H99Q.

8. The nucleic acid molecule of claim 7, wherein the encoded modified u-PA polypeptide comprises V41R and one or more of the replacements L97bA, R35Q, H99Q, D60aP, and T97aI.

9. The nucleic acid molecule of claim 1, wherein the encoded modified u-PA polypeptide comprises the replacement V41R, or the replacements V41R and C122S.

10. The nucleic acid molecule of claim 1, wherein the encoded modified u-PA polypeptide further comprises the replacement V38E.

11. The nucleic acid molecule of claim 7, wherein the encoded modified u-PA polypeptide comprises the replacement H37Y.

12. The nucleic acid molecule of claim 1, wherein the encoded modified u-PA polypeptide comprises the modifications V38E/V41R.

13. The nucleic acid molecule of claim 1, wherein the encoded modified u-PA polypeptide comprises the replacements R35Y/H37S/V38E/V41R or R35Y/H37Y/V38E/V41R.

14. The nucleic acid molecule of claim 1, wherein the encoded modified u-PA polypeptide comprises the replacements H37Y/V38E, R35Y/H37K, R35Q/H37K, R35Q/H37Y, V38E/V41R, V38E/V41R/Y149R, T39Y/V41R/D60aP/L97bA/H99Q/C122S, T39Y/V41R/D60aP/L97bA/H99Q, T39Y/V41R/Y60bQ/L97bA/H99Q, or T39Y/V41R/Y60bQ/L97bA/H99Q/C122S.

15. The nucleic acid molecule of claim 1, wherein the encoded modified u-PA polypeptide comprises the replacements R35Q/H37Y/T39Y/V41R, R35Q/H37Y/T39Y/V41R/C122S, R35Q/H37Y/T39Y/V41R/L97bA/H99Q/C122S, or R35Q/H37Y/T39Y/V41R/L97bA/H99Q.

16. The nucleic acid molecule of claim 1, wherein the encoded modified u-PA polypeptide comprises amino acid modifications selected from:
R35Y/H37S/R37aP/V38E/T39Y/V41R/D60aP/Y60bD/T97aI/L97bA/H99Q/C122S/Y151L;
R35W/R36Q/H37S/V38P/T39Y/V41R/Y60bN/T97aE/L97bA/H99Q/C122S/Y149R/Y151L;
F30Y/R35Y/R36H/H37K/V38E/T39F/Y40F/V41R/K82R/T97aI/L97bA/H99Q/K110aR/C122S/Y149R/M157K;
F30Y/R35Y/R36H/H37K/V38E/T39F/Y40F/V41R/T97aI/L97bA/H99Q/C122S/Y149R/M157K/K179R;
F30Y/R35Y/R36H/H37K/V38E/T39F/Y40F/V41R/K92R/T97aI/L97bA/H99Q/C122S/Y149R/M157K;
F30Y/R35V/R36H/H37G/V38E/T39W/Y40H/V41R/Y60bW/T97aI/L97bA/H99Q/C122S/Y149E/M157K;
F30Y/R35Y/R36H/H37K/V38E/T39F/Y40F/V41R/K92S/T97aI/L97bA/H99Q/C122S/Y149R/M157K;
F30Y/R35Y/R36H/H37K/V38E/T39F/Y40F/V41R/K61R/K62R/T97aI/L97bA/H99Q/C122S/Y149R/M157K;
F30Y/R35Y/R36H/H37K/V38E/T39F/Y40F/V41R/T97aI/L97bA/H99Q/C122S/Y149R/M157K/K179S;
R35W/H37P/R37aN/V38E/T39Y/V41R/D60aP/Y60bL/T97aI/L97bA/H99Q/C122S;
F30Y/R35W/R36T/H37S/V38S/T39Y/Y40L/V41R/Y60bN/T97aE/L97bA/H99Q/C122S/Y149R/Y151L/M157R/Q192Y;
F30Y/R35Y/R36H/H37K/V38E/T39F/Y40F/V41R/T97aI/L97bA/H99Q/C122S/M157K;
F30Y/R35Y/R36H/H37K/V38E/T39F/Y40F/V41R/K61S/K62S/T97aI/L97bA/H99Q/C122S/Y149R/M157K;
R35A/H37E/R37aG/V38E/T39Y/V41R/D60aP/Y60bD/T97aI/L97bA/H99Q/C122S/Y151L;
R35W/R36Q/H37S/V38T/T39Y/Y40H/V41R/Y60bN/T97aE/L97bA/H99Q/C122S/Y149R/Y151P/M157R;
F30Y/R35W/H37Y/V38E/T39Y/Y40H/V41R/Y60bN/T97aE/L97bA/H99Q/C122S/Y149R;
V38E/T39W/V41R/D60aW/Y60bP/L97bG/H99L/C122S;
R35W/R36K/H37S/V38E/T39Y/Y40L/V41R/Y60bN/T97aE/L97bA/H99Q/C122S/Y149R/Y151L/M157S/Q192H;
R35Q/H37Y/R37aP/V38E/T39Y/V41R/D60aQ/Y60bP/T97aI/L97bA/H99Q/C122S/Y149R;
I17V/F30Y/R35Q/R36H/H37W/V38E/Y40H/V41R/T97aI/L97bA/H99Q/C122S/M157K/T158A;
R35Y/H37S/R37aP/V38E/T39Y/V41R/D60aP/Y60bD/T97aI/L97bA/H99Q/C122S/Y151L/Q192H;
F30Y/R35W/R36H/H37D/V38E/T39Y/Y40F/V41R/T97aI/L97bA/H99Q/C122S/Y149R/M157K;
R35W/R36N/H37S/V38E/T39Y/Y40M/V41R/Y60bN/T97aE/L97bA/H99Q/C122S/Y149R/M157S;

R35Y/H37D/V38E/T39W/V41R/D60aP/Y60bE/T97aI/
  L97bA/H99Q/C122S/Y149R;
F30Y/R35Y/R36H/H37K/V38E/T39F/Y40F/V41R/
  K82S/T97aI/L97bA/H99Q/K110aS/C122S/Y149R/
  M157K;
R35W/H37P/R37aN/V38E/T39Y/V41R/D60aP/Y60bL/
  D97T/T97aE/L97bG/A98S/H99L/C122S;
R35Y/H37S/R37aP/V38E/T39Y/V41R/D60aP/Y60bD/
  T97aI/L97bA/H99Q/C122S;
F30Y/R35W/H37S/V38E/T39Y/Y40H/V41R/Y60bN/
  T97aI/L97bA/H99Q/C122S/Y149R/M157K;
F30Y/R35W/H37S/V38E/T39Y/Y40H/V41R/Y60bN/
  T97aE/L97bA/H99Q/C122S/M157K;
R35H/V38E/T39Y/V41R/D60aP/Y60bQ/L97bA/H99Q/C122S/T158A;
R35Q/R36H/H37Y/V38E/T39Y/Y40L/V41R/T97aI/L97bA/H99Q/C122S/Y149R/M157K;
R35W/H37P/R37aG/V38E/T39Y/V41R/D60aP/Y60bE/T97aI/L97bA/H99Q/C122S/Y149R;
V38D/V41Q/D60aH/Y60bS/T97aW/L97bR/H99E/C122S/Y151L/E175D/R217E/K224R;
F30Y/R35W/R36H/H37P/R37aQ/V38E/T39Y/Y40F/V41R/Y60bQ/T97aE/L97bA/H99Q/C122S/Y149R/M157K;
F30Y/R35W/R36Q/H37S/V38P/T39Y/Y40L/V41R/Y60bN/T97aE/L97bA/H99Q/C122S/Y149R/M157R;
F30H/R35W/R36T/H37S/V38P/T39Y/V41R/Y60bN/T97aE/L97bA/H99Q/C122S/Y149R/Y151L/M157S;
F30Y/R35W/R36H/H37D/V38E/T39Y/Y40H/V41R/Y60bD/T97aI/L97bA/H99Q/C122S/M157K;
F30Y/R35Y/R36H/H37N/V38E/T39F/Y40F/V41R/K61E/R72H/T97aI/L97bA/H99Q/C122S/Y149R/M157K/Q169K;
R35W/R36Q/H37S/V38S/T39Y/V41R/Y60bN/T97aE/L97bA/H99Q/C122S/Y149R/Y151L/M157S/Q192H;
R35W/H37G/R37aE/V38E/T39Y/V41R/D60aP/Y60bD/T97aI/L97bA/H99Q/C122S/Y151L/Q192T;
R35W/H37P/R37aN/V38E/T39Y/V41R/D60aP/Y60bL/T97aI/L97bA/H99Q/C122S/Y149R;
F30Y/R35W/H37S/V38E/T39Y/Y40H/V41R/Y60bN/T97aE/L97bA/H99Q/C122S;
F30Y/R35V/R36H/H37G/V38E/T39W/Y40H/V41R/Y60bA/T97aI/L97bA/H99Q/C122S/Y149R/M157K;
F30Y/R35W/R36H/H37S/V38E/T39Y/Y40H/V41R/Y60bN/T97aE/L97bA/H99Q/C122S/Y149R;
F30Y/R35W/H37S/V38E/T39Y/Y40H/V41R/Y60bN/T97aE/L97bA/H99Q/C122S/Y149R;
F30Y/R35W/R36H/H37S/V38E/T39Y/Y40H/V41R/Y60bN/T97aE/L97bA/H99Q/C122S/M157K;
F30Y/R35W/R36H/H37S/V38E/T39Y/Y40H/V41R/Y60bN/T97aE/L97bA/H99Q/C122S;
F30Y/R35W/R36S/H37S/V38Q/T39Y/Y40L/V41R/Y60bN/T97aE/L97bA/H99Q/C122S/Y149R/Y151L/M157S/Q192N;
F30Y/R35W/R36H/H37P/R37aD/V38E/T39Y/Y40F/V41R/D60aE/Y60bS/T97aE/L97bA/H99Q/C122S/Y149R/M157K;
R35Q/H37Y/R37aS/V38E/T39Y/V41R/D60aP/Y60bE/T97aI/L97bA/H99Q/C122S/Y149R;
R37aS/V38E/Y40V/V41R/H99L/C122S/Y151L/R217V;
V38D/V41R/L97bG/H99Q/C122S/Y151L/R217E;
R35Q/H37Y/R37aE/V38E/T39Y/V41R/D60aP/Y60bQ/T97aI/L97bA/H99Q/C122S;
F30Y/R35V/R36H/H37D/V38E/T39W/Y40H/V41R/Y60bP/T97aI/L97bA/H99Q/C122S/Y149R/M157K;
I17V/F30Y/R35Q/R36H/H37W/V38E/Y40H/V41R/T97aI/L97bA/H99Q/C122S/M157K;
F30Y/R35V/R36H/H37S/V38E/T39F/Y40H/V41R/Y60bS/T97aM/L97bA/H99Q/C122S/Y149W/M157K;
R35Y/H37S/R37aP/V38E/T39Y/V41R/D60aP/Y60bD/T97aI/L97bA/H99Q/C122S/Y149R;
N26D/F30Y/R35Y/R36H/H37E/V38E/T39F/Y40F/V41R/K61E/T97aI/L97bA/H99Q/R110dS/P114S/C122S/Y149R/M157K;
F30Y/R35W/R36H/H37P/R37aE/V38E/T39Y/Y40F/V41R/Y60bA/T97aE/L97bA/H99Q/C122S/Y149R/M157K;
R35L/H37D/R37aN/V38E/T39Y/V41R/D60aP/T97aI/L97bA/H99Q/C122S/Y149R;
F30Y/R35W/R36H/H37P/V38E/T39Y/Y40F/V41R/Y60bS/T97aE/L97bA/H99Q/C122S/Y149K/M157K;
R35Q/H37Y/R37aE/V38E/T39Y/V41R/D60aP/T97aI/L97bA/H99Q/C122S/Y149R;
R35H/V38E/T39Y/V41R/D60aP/Y60bQ/L97bA/H99Q/C122S/T158S/E167K;
R35Q/H37Y/V38E/T39Y/V41R/D60aP/Y60bQ/T97aI/L97bA/H99Q/C122S/Y149R;
F30Y/R35Y/R36H/H37D/V38E/T39W/Y40H/V41R/Y60bE/T97aI/L97bA/H99Q/C122S/Y149R/M157K;
F30Y/R35Y/R36H/H37K/V38E/T39F/Y40F/V41R/T97aI/L97bA/H99Q/C122S/Y149R/M157K;
F30Y/R35Y/R36H/H37E/V38E/T39F/Y40F/V41R/K61E/T97aI/L97bA/H99Q/C122S/Y149R/M157K/T242A;
F30Y/R35L/V38D/Y40H/V41R/L97bA/H99Q/C122S/M157K/T158A;
F30Y/R35Y/R36H/H37P/R37aQ/V38E/T39Y/Y40F/V41R/Y60bH/T97aE/L97bA/H99Q/C122S/Y149R/M157K;
V38D/V41R/L97bR/H99E/C122S/Y151L/R217E;
H37G/R37aD/G37bD/V38F/T39H/V41R/Y60bK/T97aS/L97bR/H99E/C122S/Y151L/E175D/R217E/K224R;
R35Y/H37V/R37aW/V38E/T39Y/V41R/D60aP/Y60bE/T97aI/L97bA/H99Q/C122S/Y151L/Q192T;
F30Y/R35M/R36H/H37G/V38E/T39F/Y40H/V41R/Y60bP/T97aF/L97bA/H99Q/C122S/Y149R/M157K;
F30Y/R35W/R36Q/H37S/V38T/T39Y/Y40L/V41R/Y60bN/T97aE/L97bA/H99Q/C122S/Y149R/Y151L/M157K/Q192T;
R35W/H37D/R37aP/V38E/T39W/V41R/D60aR/Y60bS/T97aI/L97bA/H99Q/C122S/Y149R;
I17V/F30Y/R35W/R36H/H37E/V38E/T39W/Y40H/V41R/Y60bQ/T97aE/L97bA/H99Q/C122S/Y149K/M157K;
I17V/F30Y/R35Q/H37W/V38D/Y40H/V41R/Y60bN/L97bA/H99Q/C122S/Y149H/M157K/T158A;
R35H/V38E/T39Y/V41R/D60aP/Y60bQ/L97bA/H99Q/C122S/1138V/E167K;
F30Y/R35W/R36Q/H37S/V38E/T39Y/Y40L/V41R/Y60bN/T97aE/L97bA/H99Q/C122S/Y149R/Y151L/M157T/Q192H;
R35H/G37bD/V38E/T39Y/V41R/D60aP/Y60bQ/L97bA/H99Q/C122S/T158S;
R35H/H37P/R37aG/V38E/T39F/V41R/D60aP/Y60bE/T97aI/L97bA/H99Q/C122S/Y149R;
F30Y/R35W/R36H/H37S/V38E/T39Y/Y40H/V41R/Y60bN/T97aE/L97bA/H99Q/C122S/Y149R/M157K;
V38D/T39Y/Y40L/V41R/L97bI/H99E/C122S/R217E;
F30Y/R36H/V38E/Y40H/V41R/T97aI/L97bA/H99Q/C122S/M157K/T158A;
F30H/R35W/R36H/H37S/V38E/T39Y/Y40M/V41R/Y60bN/T97aE/L97bA/H99Q/C122S/Y149R/M157K;
R35V/R36H/H37D/V38E/T39W/Y40M/V41R/T97aI/L97bA/H99Q/C122S/Y149R/M157K;

R35W/R36K/H37S/V38A/T39Y/V41R/Y60bN/T97aE/
L97bA/H99Q/C122S/Y149R/Y151L/M157R/Q192T;
F30Y/R35W/R36H/H37D/V38E/T39Y/Y40H/V41R/
Y60bA/T97aI/L97bA/H99Q/C122S/Y149R/M157K;
F30Y/R35W/R36H/H37S/V38E/T39Y/Y40F/V41R/
Y60bN/T97aE/L97bA/H99Q/C122S/N145S/S146V/
T147 M/D148G/Y149Q/L150F/M157K;
F30Y/R35Y/R36H/H37K/V38E/T39F/Y40F/V41R/T97aI/L97bA/H99Q/Y149R/M157K;
F30Y/R35I/R36H/H37D/V38E/T39F/Y40F/V41R/T97aI/L97bA/H99Q/C122S/Y149R/M157K;
R35V/V38E/Y40Q/V41L/Y60bS/T97aE/L97bA/H99Q/C122S/Y149R;
R35Q/H37Y/R37aP/V38E/T39Y/V41R/D60aN/Y60bN/T97aI/L97bA/H99Q/C122S/Y149R;
V38E/Y40Q/V41L/L97bG/H99Q/C122S/R217T;
R35H/V38E/T39Y/V41R/T56S/D60aP/Y60bQ/L97bA/H99Q/C122S/T158S;
F30H/R35Q/H37W/V38D/V41R/L97bA/H99Q/C122S/Y151L/M157K;
R35Q/H37Y/V38E/T39Y/V41R/D60aP/T97aI/L97bA/H99Q/C122S/Y149R;
R35W/H37P/R37aN/V38E/T39Y/V41K/D60aP/Y60bD/T97aI/L97bA/H99Q/C122S/Y151L/Q192A;
V38D/V41R/Y60bR/T97aW/L97bR/H99E/C122S/E175D/R217E/K224R;
F30Y/R35W/R36H/H37S/V38E/Y40H/Y60bN/T97aI/L97bA/H99Q/C122S/Y149R;
V38D/V41L/Y60bP/T97aM/L97bR/H99E/C122S/Y151L/E175D/R217E/K224R;
F30Y/R35W/R36H/H37D/V38E/T39F/Y40H/V41R/Y60bE/T97aI/L97bA/H99Q/C122S/Y149R/M157K;
F30Y/R35W/R36H/H37N/V38E/T39Y/Y40F/V41R/Y60bS/T97aE/L97bA/H99Q/C122S/Y149K/M157K;
F30Y/R35W/R36K/H37S/V38D/T39Y/Y40L/V41R/Y60bN/T97aE/L97bA/H99Q/C122S/Y149R/Y151L/M157R/Q192T;
V41R/H99Q/C122S/Y151L/R217V;
V38E/Y40P/V41L/L97bG/H99L/C122S/Y151Q/R217E;
V38E/Y40L/V41R/H99L/C122S/Y151L/R217S;
V38E/Y40Q/V41L/L97bG/H99Q/C122S/Y151P/R217T;
V38E/T39Y/V41R/D60aW/Y60bP/L97bR/H99I/C122S;
R35W/H37D/R37aP/V38E/T39W/V41R/Y60bA/T97aI/L97bA/H99Q/C122S/Y149R;
F30Y/R36H/H37F/V38E/T39Y/Y40H/V41R/Y60bD/T97aV/L97bA/H99Q/C122S/Y149L/M157K;
F30Y/R35W/R36H/H37E/S37dP/V38E/T39W/Y40H/V41R/Y60bQ/T97aE/L97bA/H99Q/C122S/Y149K/M157K;
R35Q/H37Y/R37aE/V38E/T39Y/V41R/D60aA/Y60bP/T97aI/L97bA/H99Q/C122S/Y149R;
R36H/V38D/V41R/A96D/D97E/A98G/T97adel/H99L/L97bdel/C122S/T178S/R217D;
V38D/V41R/L97bG/H99Q/C122S/Y151L/R217A;
F30H/R35Q/R36H/H37Y/V38E/T39Y/Y40L/V41R/T97aI/L97bA/H99Q/C122S/Y149R/M157K;
F30Y/R35W/R36K/H37E/V38E/T39W/Y40H/V41R/Y60bQ/K61E/165T/T97aE/L97bA/H99Q/C122S/Y149K/M157K;
F30Y/R35W/R36H/H37D/V38E/T39Y/Y40H/V41R/Y60bS/T97aL/L97bA/H99Q/C122S/Y149L/M157K;
F30Y/R35Q/R36H/H37Y/R37aE/V38E/T39Y/Y40F/V41R/D60aS/Y60bP/T97aE/L97bA/H99Q/C122S/Y149R/M157K;
R35Q/H37Y/R37aE/V38E/T39Y/V41R/D60aG/Y60bS/T97aI/L97bA/H99Q/C122S/Y149R;
I24N/F30Y/R35W/R36H/H37E/V38E/T39W/Y40L/V41R/Y60bQ/N87D/T97aE/L97bA/H99Q/C122S/Y149K/M157K;
V38E/Y40Q/V41L/L97bA/H99Q/C122S;
F30Y/R35Q/H37W/V38D/Y40H/V41R/Y60bN/L97bA/H99Q/C122S/Y149H/M157K/T158A;
F30Y/R35W/R36A/H37E/V38E/T39W/Y40H/V41R/Y60bQ/K61D/165R/T97aE/L97bA/H99Q/C122S/Y149K/M157K;
F30Y/R35Q/R36H/H37W/V38E/Y40H/V41R/T97aI/L97bA/H99Q/C122S/M157K;
F30Y/R35Y/R36H/H37K/V38E/T39F/Y40F/V41R/T97aI/L97bA/H99Q/C122S/Y149R/M157K/K187R/K223R/K224R;
R35W/R36Q/H37S/V38E/T39Y/Y40L/V41R/Y60bN/T97aE/L97bA/H99Q/C122S/Y149R/Y151L/M157S/Q192T;
R35H/V38E/T39Y/V41R/D60aP/Y60bQ/P60cS/L97bA/H99Q/C122S/1138V/E167K;
R35Q/H37Y/R37aE/V38E/T39Y/V41R/D60aT/Y60bT/T97aI/L97bA/H99Q/C122S/Y149R;
I17V/F30Y/R36H/V38E/Y40H/V41R/T97aI/L97bA/H99Q/C122S/M157K;
R35Y/R36H/H37K/V38E/T39F/V41R/T97aI/L97bA/H99Q/C122S/Y149R/M157K;
R35H/V38E/T39Y/V41R/T56A/D60aP/Y60bQ/L97bA/H99Q/C122S;
F30Y/V38D/Y40F/V41L/L97bA/H99Q/C122S/Y151L/M157R;
V38E/Y40A/V41L/L97bG/H99Q/C122S/R217T;
I24T/F30Y/R35W/R36H/H37E/V38E/T39W/Y40H/V41R/Y60bQ/T97aE/L97bA/H99Q/C122S/Y149K/M157K;
F30Y/R35W/R36H/H37S/V38E/T39Y/Y40F/V41R/Y60bN/T97aE/L97bA/H99Q/C122S/Y149R/M157K;
I17V/F30Y/V38D/Y40H/V41R/L97bA/H99Q/C122S/M157K/T158A;
R35W/H37P/R37aN/V38E/T39Y/V41K/D60aP/Y60bD/T97aI/L97bA/H99Q/C122S/Y151L/Q192T;
F30H/R35L/H37D/V38D/V41R/L97bA/H99Q/C122S/Y151L/M157K/R217E;
F30Y/R35W/R36H/H37D/R37aE/V38E/T39Y/Y40F/V41R/D60aE/Y60bF/T97aE/L97bA/H99Q/C122S/Y149R/M157K;
F30Y/R35L/R36H/H37G/V38E/T39Y/Y40H/V41R/Y60bP/T97aE/L97bA/H99Q/C122S/Y149M/M157K;
I17V/F30H/V38D/V41R/L97bA/H99Q/C122S/Y151L/M157K;
F30Y/R35V/R36H/H37K/V38E/T39F/Y40H/V41R/Y60bN/T97aI/L97bA/H99Q/C122S/Y149R/M157K;
R35W/R36H/H37N/V38E/T39F/Y40F/V41R/T97aI/L97bA/H99Q/C122S/Y149R/M157K/Q192H;
R35V/Y40Q/V41L/Y60bS/T97aE/L97bA/H99Q/C122S/Y149R;
F30Y/R35M/R36H/H37G/R37aE/V38E/T39Y/Y40F/V41R/D60aP/Y60bS/T97aE/L97bA/H99Q/C122S/Y149R/M157K;
R35Q/V38D/V41R/L97bG/H99Q/C122S/Y151L;
R37aS/V38E/Y40P/V41L/L97bG/H99Q/C122S/Y151Q/R217T;
R35V/R37aE/V38E/Y40Q/V41L/T97aE/L97bA/H99Q/C122S/Y149R;
F30H/V38D/V41R/A96G/L97bA/H99Q/C122S/Y151L/M157K;
T39L/Y40L/V41R/T97aI/L97bA/H99Q/C122S;
F30Y/R35W/R36H/H37E/V38E/T39Y/Y40F/V41R/Y60bQ/T97aE/L97bA/H99Q/C122S/Y149R/M157K;

Y40Q/V41L/Y60bL/L97bA/H99Q/C122S;
F30Y/R36H/V38E/Y40H/V41R/T97aI/L97bA/H99Q/
C122S/S146F/M157K/Q192H/K243Q;
Y40Q/V41L/L97bA/H99Q/C122S/Y149R;
F30Y/R35W/R36Q/H37E/V38E/T39W/Y40H/V41R/
Y60bQ/K61L/I65V/T97aE/L97bA/H99Q/C122S/
Y149K/M157K;
R35Q/H37Y/R37aE/V38E/T39Y/V41R/D60aP/Y60bQ/
T97aI/L97bA/H99Q/C122S/Y149R;
R35Q/V38D/V41R/T97aS/L97bA/H99Q/C122S/Y151L;
V41R/L97bR/H99Q/C122S/Y151L/R217V;
R35Q/H37Y/R37aE/V38E/T39Y/V41R/D60aP/Y60bQ/
L97bA/H99Q/C122S/Y149R;
F30Y/R35V/R36H/H37S/V38E/T39Y/Y40H/V41R/Y60bP/T97aE/L97bA/H99Q/C122S/Y149E/M157K;
R35A/H37T/R37aD/V38E/T39Y/V41R/D60aP/Y60bD/T97aI/L97bA/H99Q/C122S/Y151L/Q192S;
R35S/V38D/V41R/L97bA/H99Q/C122S/Y151L;
R35S/V38D/V41L/L97bG/H99Q/C122S/Y151L/R217Q;
F30Y/R35H/V38D/Y40H/V41R/L97bA/H99Q/C122S/M157K/T158S;
R35Q/H37S/R37aE/V38E/T39Y/V41R/D60aP/Y60bS/T97aI/L97bA/H99Q/C122S/Y149R;
H37G/R37aD/V38F/T39H/V41R/Y60bK/L97bR/H99E/C122S/Y151L/E175D/Q192T/R217E/K224R;
H37G/R37aD/V38F/T39H/V41R/Y60bK/L97bR/H99E/C122S/Y151L/E175D/Q192T/R217E;
R35W/H37D/R37aS/V38E/T39Y/V41R/D60aE/Y60bS/T97aI/L97bA/H99Q/C122S/Y149R;
R35Q/H37G/R37aD/V38E/T39Y/V41R/D60aP/Y60bA/T97aI/L97bA/H99Q/C122S/Y149R;
R35Q/H37D/R37aK/V38E/T39F/V41R/D60aP/Y60bS/T97aI/L97bA/H99Q/C122S/Y149R;
R35Y/R36H/H37S/V38D/T39Y/V41R/Y60bN/T97aI/L97bA/H99Q/C122S/Y149R;
F30Y/R36H/V38E/Y40H/V41R/K61E/T97aI/L97bA/H99Q/C122S/M157K;
R37aS/V38D/V41Q/L97bG/H99Q/C122S/Y151L/R217T;
F30H/V38D/V41R/L97bA/H99Q/C122S/Y151L/M157K;
F30Y/R35K/R36H/H37E/R37aK/V38E/T39F/Y40F/V41R/D60aP/Y60bS/T97aI/L97bA/H99Q/C122S/Y149R/M157K;
F30Y/R35Q/R36H/H37G/R37aE/V38E/T39Y/Y40F/V41R/D60aP/Y60bG/T97aI/L97bA/H99Q/C122S/Y149R/M157K;
F30Y/R35W/R36Q/H37E/V38A/T39W/Y40H/V41R/Y60bQ/K61D/165V/T97aE/L97bA/H99Q/C122S/Y149K/M157K;
F30Y/R35H/V38D/Y40H/V41R/T56A/L97bA/H99Q/C122S/M157K;
R35N/H37T/R37aY/V38E/T39Y/V41R/D60aP/Y60bE/T97aI/L97bA/H99Q/C122S/Y149R;
R37aH/V38E/T39Y/V41R/T56A/D60aP/Y60bQ/L97bA/H99Q/C122S/T158A;
F30H/R35Q/H37T/V38D/V41R/L97bA/H99Q/C122S/Y151L/M157K;
F30H/R36L/V38E/V41R/K82R/L97bA/H99Q/C122S/Y151L/M157K;
V38D/V41R/H99Q/C122S/Y151L/R217V;
R35Q/H37G/R37aP/V38E/T39Y/V41R/D60aP/Y60bE/T97aI/L97bA/H99Q/C122S/Y149R;
F30Y/R35Q/R36H/H37Y/R37aE/V38E/T39Y/Y40F/V41R/D60aE/Y60bA/T97aE/L97bA/H99Q/C122S/Y149R/M157K;
R35Q/H37Y/R37aD/V38E/T39L/V41R/D60aE/Y60bT/T97aI/L97bA/H99Q/C122S/Y149R;
F30Y/R35L/R36H/H37E/V38E/T39N/Y40F/V41R/T97aI/L97bA/H99Q/C122S/Y149R/M157K;
R36S/V38E/Y40L/V41N/L97bG/H99Q/C122S/Y151L/R217T;
T39W/V41R/L97bG/H99Q/C122S;
F30Y/R35W/R36H/H37E/V38E/T39W/Y40H/V41R/Y60bQ/T97aE/L97bA/H99Q/C122S/Y149K/M157K;
R35Q/H37Y/R37aE/V38E/T39Y/V41R/Y60bQ/T97aI/L97bA/H99Q/C122S/Y149R;
R35S/R37aA/V38E/Y40Q/V41L/L97bA/H99Q/C122S/Y149V;
F30Y/R35W/R36H/H37Q/V38E/T39H/Y40H/V41R/T97aE/L97bA/H99Q/C122S/Y149L/M157K;
F30Y/R35Q/R36H/H37Y/R37aD/V38E/T39Y/Y40F/V41R/Y60bV/T97aE/L97bA/H99Q/C122S/Y149R/M157K;
F30H/V38D/V41R/L97bA/H99Q/Y151L/M157K;
F30H/R35H/H37I/V38D/V41R/L97bA/H99Q/C122S/Y149W/Y151L/M157K/R217S;
V38D/T39Y/Y40H/V41R/T97aI/L97bA/H99Q/C122S;
R35F/H37D/R37aN/V38E/T39Y/V41R/Y60bS/T97aI/L97bA/H99Q/C122S/Y149R;
T39Y/V41R/Y60bQ/L97bG/H99Q/C122S;
T39Y/V41R/D60aP/Y60bQ/L97bA/H99Q/C122S;
V38D/V41R/L97bR/H99Q/C122S/Y151L/R217E;
R36S/V38D/T39L/Y40L/V41R/L97bI/H99E/C122S/R217T;
R35S/R37aD/V38E/Y40Q/V41L/Y60bV/T97aL/L97bA/H99Q/C122S/Y149L;
Y40Q/V41L/Y60bT/T97aE/L97bA/H99Q/C122S/Y149R;
F30Y/V38E/Y40H/V41R/T56A/L97bA/H99Q/C122S/M157K/K243M;
F30Y/R36H/R37aH/V38E/Y40H/V41R/K61E/T97aI/L97bA/H99Q/C122S/M157K;
F30H/R35Q/V38D/V41R/L97bA/H99Q/C122S/Y151L/M157K;
V38D/V41R/Y60bK/T97aS/L97bR/H99E/C122S/Y151L/E175D/Q192T/R217E/K224R;
H37G/G37bD/V38F/T39H/V41R/Y60bK/T97aS/L97bR/H99E/C122S/Y151L/E175D/Q192T/R217E/K224R;
R35S/R37aD/V38E/Y40Q/V41L/T97aE/L97bA/H99Q/C122S/Y149R;
R35V/R37aE/V38E/Y40Q/V41L/Y60bS/T97aE/L97bA/H99Q/C122S;
Y40Q/V41L/Y60bS/T97aE/L97bA/H99Q/C122S/Y149R;
F30Y/R35H/V38D/Y40H/V41R/L97bA/H99Q/C122S/1138V/M157K;
T39Y/V41R/Y60bQ/L97bA/H99Q/C122S;
F30Y/R35H/R36H/H37D/R37aE/V38E/T39Y/Y40F/V41R/D60aP/Y60bD/T97aI/L97bA/H99Q/C122S/Y149R/M157K;
F30Y/V38D/Y40H/V41R/L97bA/H99Q/C122S/M157K/T158A;
V38E/T39W/V41R/D60aP/Y60bD/L97bA/H99L/C122S;
F30Y/R36H/V38E/Y40H/V41R/165T/T97aI/L97bA/H99Q/C122S/M157K;
V38D/V41R/L97bR/H99Q/C122S/Y151L/R217V;
R35Q/H37S/R37aP/V38E/T39Y/V41R/D60aP/Y60bE/T97aI/L97bA/H99Q/C122S/Y149R;
R35W/R36H/H37S/V38E/T39Y/V41R/Y60bN/T97aE/L97bA/H99Q/C122S/Y149R/M157K;

R36S/V38E/Y40Q/V41R/L97bG/H99L/C122S/Y151P/
R217E;
V38E/Y40Q/V41L/Y60bL/L97bA/H99Q/C122S;
H37G/R37aD/G37bD/V38F/T39H/V41R/Y60bK/
L97bR/H99E/C122S/Y151L/E175D/Q192T/R217E;
H37G/R37aD/V38F/T39H/V41R/Y60bK/T97aS/L97bR/H99E/C122S/Y151L/E175D/Q192T/R217E;
F30Y/R35Y/R36H/H37K/V38E/T39F/Y40F/V41R/T97aI/L97bA/H99Q/C122S/Y149R/M157K/K187S/K223S/K224Y;
Y40Q/V41L/L97bA/H99Q/C122S;
F30H/R35H/V38D/V41R/K61E/L97bA/H99Q/C122S/Y151L/M157K/R206H;
F30Y/V38D/Y40H/V41R/L97bA/H99Q/C122S/M157K;
F30Y/R36H/V38E/Y40H/V41R/T97aE/L97bA/H99Q/C122S/Y149R/M157K;
R35A/R37aE/V38E/Y40Q/V41L/L97bA/H99Q/C122S/Y149R;
V38D/V41L/L97bG/H99Q/C122S/Y151L/R217Q;
F30H/R35Q/H37W/V38D/V41R/D60aE/L97bA/H99Q/C122S/Y149L/Y151L/M157K/R217D;
F30Y/R35F/R36H/H37G/V38E/T39Y/Y40H/V41R/Y60bS/T97aD/L97bA/H99Q/C122S/Y149R/M157K;
T39Y/V41R/L97bG/H99Q/C122S;
F30Y/R35I/R36H/H37E/V38E/T39Y/Y40H/V41R/Y60bS/T97aV/L97bA/H99Q/C122S/Y149L/M157K;
R35S/R37aD/V38E/Y40Q/V41L/L97bA/H99Q/C122S/Y149R;
Y40H/V41Q/L97bG/H99Q/C122S/R217T;
R35W/H37D/V38D/T39Y/V41R/Y60bS/L97bA/H99Q/C122S/Y149R;
V38D/T39F/Y40L/V41R/T97aW/L97bA/H99Q/C122S;
V38D/T39Y/Y40L/V41R/T97aE/L97bA/H99Q/C122S;
F30Y/R35Q/R36H/H37G/R37aE/V38E/T39F/Y40F/V41R/D60aP/Y60bS/T97aE/L97bA/H99Q/C122S/Y149R/M157K;
V38D/T39L/Y40L/V41R/T97aI/L97bA/H99Q/C122S;
V38D/T39Y/Y40L/V41R/T97aW/L97bA/H99Q/C122S;
F30Y/R36H/V38D/Y40H/V41R/L97bA/H99L/C122S/F141L/M157K/T158A;
F30Y/R35Q/R36H/H37G/R37aE/V38E/T39Y/Y40F/V41R/D60aA/Y60bS/T97aE/L97bA/H99Q/C122S/Y149R/M157K;
F30Y/R35Q/R36H/H37G/R37aE/V38E/T39Y/Y40F/V41R/D60aP/Y60bS/T97aE/L97bA/H99Q/C122S/Y149R/M157K;
T39Y/V41R/Y60bP/L97bG/H99Q/C122S;
F30H/R36H/V38D/V41R/T56A/L97bA/H99Q/C122S/Y151L/M157K;
F30Y/R35E/R36H/H37D/R37aN/V38E/T39Y/Y40F/V41R/Y60bN/T97aE/L97bA/H99Q/C122S/Y149R/M157K;
V38E/Y40Q/V41L/D60aP/Y60bL/L97bA/H99Q/C122S/Y149W;
F30Y/R36H/V38E/Y40H/V41R/T97aI/L97bA/H99Q/C122S/M157K;
F30H/R35Q/H37W/V38D/V41R/D60aE/Y60bS/L97bA/H99Q/C122S/Y149L/Y151L/M157K;
R35Q/H37G/R37aE/V38E/T39Y/V41R/D60aP/Y60bT/T97aI/L97bA/H99Q/C122S/Y149R;
F30Y/R35W/R36H/H37S/V38E/T39Y/Y40H/V41R/Y60bN/T97aE/L97bA/H99Q/C122S/Y149R/Y151P/M157K/Q192H;
F30Y/R35M/R36H/H37D/R37aD/V38E/T39Y/Y40F/V41R/D60aP/Y60bS/T97aE/L97bA/H99Q/C122S/Y149R/M157K;
F30Y/R35W/R36H/H37D/V38E/T39Y/Y40H/V41R/Y60bT/T97aD/L97bA/H99Q/C122S/Y149R/M157K;
V38D/T39L/Y40L/V41R/T97aV/L97bA/H99Q/C122S;
V38D/V41R/Y60bS/T97aI/L97bR/H99E/C122S/Y151L/E175D/Q192F/R217E/K224R;
T39Y/V41R/Y60bP/L97bA/H99Q/C122S;
R36H/V38D/Y40F/V41R/D97E/A98G/T97adel/H99L/L97bdel/C122S/Y151L/Q192E/R217D;
R35M/H37G/R37aD/V38E/T39W/V41R/D60aP/Y60bD/T97aI/L97bA/H99Q/C122S/Y149R;
F30Y/V38D/Y40L/V41R/L97bA/H99Q/C122S/Y151L/M157K/Q192H;
F30H/V38D/Y40F/V41R/L97bA/H99Q/C122S/Y151L/M157F;
H37M/R37aD/V38E/T39A/V41R/D60aP/Y60bS/T97aI/L97bA/H99Q/C122S/Y149R;
T22I/F30Y/R35S/V38D/Y40H/V41R/L97bA/H99Q/C122S/1138V/M157K;
R35L/H37D/R37aS/V38E/T39Y/V41R/D60aP/Y60bD/T97aI/L97bA/H99Q/C122S/Y149R;
F30Y/R35L/V38D/Y40H/V41R/N76S/L97bA/H99Q/C122S/M157K/K187E;
F30H/V38D/V41R/L97bA/H99Q/C122S/Y151L/M157S;
R35W/H37D/V38D/T39Y/V41R/Y60bH/L97bA/H99Q/C122S/Y149R;
F30Y/R36H/H37G/V38E/T39W/Y40H/V41R/Y60bA/T97aE/L97bA/H99Q/C122S/Y149Q/M157K;
R35Q/H37G/R37aE/V38W/T39Y/V41R/Y60bK/T97aS/L97bR/H99E/C122S/Y151L/E175D/Q192T/R217E/K224R;
H37G/R37aD/G37bD/V38F/T39H/V41R/Y60bK/L97bR/H99E/C122S/Y151L/E175D/Q192T/R217E/K224R;
V38D/T39Y/Y40M/V41R/T97aE/L97bA/H99Q/C122S;
R35Q/H37N/V38D/T39Y/V41R/Y60bP/L97bA/H99Q/C122S;
F30Y/R35W/R36H/H37D/V38E/T39Y/Y40F/V41R/Y60bS/T97aE/L97bA/H99Q/C122S/Y149K/M157K;
R35Q/R37aE/V38E/T39Y/V41R/D60aP/Y60bQ/T97aI/L97bA/H99Q/C122S/Y149R;
V38E/T39L/V41R/D60aN/Y60bP/L97bG/H99Q/C122S;
F30Y/R36H/H37A/V38E/T39Y/Y40H/V41R/Y60bQ/T97aV/L97bA/H99Q/C122S/Y149R/M157K;
F30Y/R35W/R36H/H37E/R37aP/V38E/T39Y/Y40F/V41R/Y60bN/T97aE/L97bA/H99Q/C122S/Y149Q/M157K;
H37T/R37aL/V38E/T39Y/V41R/D60aP/Y60bD/T97aI/L97bA/H99Q/C122S/Y151L/Q192R;
H37G/R37aD/V38F/T39H/V41R/Y60bK/T97aS/L97bR/H99E/C122S/Y151L/E175D/Q192T/R217E/K224R;
F30Y/R35W/R36H/H37S/V38E/Y40H/Y60bN/T97aE/L97bA/H99Q/C122S/Y149R/M157K;
V38D/T39W/Y40L/V41R/T97aL/L97bA/H99Q/C122S;
H37G/R37aD/G37bD/T39H/V41R/Y60bK/T97aS/L97bR/H99E/C122S/Y151L/E175D/Q192T/R217E/K224R;
T39Y/V41R/L97bA/H99Q/C122S;
V38D/T39L/Y40L/V41R/T97aW/L97bA/H99Q/C122S;
F30Y/R36H/V38E/Y40H/V41R/T97aI/L97bA/H99Q/C122S/Y149N/L150V/M157K;
R35S/V38D/L97bA/H99Q/C122S/Y151L/M157Y;
R37aS/V38D/T39Y/Y40F/V41R/H99L/C122S/R217T;
Y40Q/V41L/Y60bE/L97bA/H99Q/C122S/Y149R;
Y40H/V41T/L97bG/H99Q/C122S/R217T; and any of the preceding polypeptides in which the amino acid residue at position 122 is not modified and is cysteine (C), by chymotrypsin numbering.

17. The nucleic acid molecule of claim 1, wherein the encoded modified u-PA polypeptide comprises the amino acid modifications:
R35Q/H37Y/R37aE/V38E/T39Y/V41R/D60aP/Y60bQ/
   T97aI/L97bA/H99Q/C122S/Y149R; or
R35Y/H37S/R37aP/V38E/T39Y/V41R/D60aP/Y60bD/
   T97aI/L97bA/H99Q/C122S/Y151L; or
R35Q/R37aE/V38E/T39Y/V41R/D60aP/Y60bQ/T97aI/
   L97bA/H99Q/C122S/Y149R; or
R35Q/H37Y/V38E/T39Y/V41R/D60aP/Y60bQ/T97aI/
   L97bA/H99Q/C122S/Y149R; or
R35Q/H37Y/R37aE/T39Y/V41R/D60aP/Y60bQ/T97aI/
   L97bA/H99Q/C122S/Y149R; or
R35Q/H37Y/R37aE/V38E/V41R/D60aP/Y60bQ/T97aI/
   L97bA/H99Q/C122S/Y149R; or
R35Q/H37Y/R37aE/V38E/T39Y/D60aP/Y60bQ/T97aI/
   L97bA/H99Q/C122S/Y149R; or
R35Q/H37Y/R37aE/V38E/T39Y/V41R/Y60bQ/T97aI/
   L97bA/H99Q/C122S/Y149R; or
R35Q/H37Y/R37aE/V38E/T39Y/V41R/D60aP/T97aI/
   L97bA/H99Q/C122S/Y149R; or
R35Q/H37Y/R37aE/V38E/T39Y/V41R/D60aP/Y60bQ/
   L97bA/H99Q/C122S/Y149R; or
R35Q/H37Y/R37aE/V38E/T39Y/V41R/D60aP/Y60bQ/
   T97aI/H99Q/C122S/Y149R; or
R35Q/H37Y/R37aE/V38E/T39Y/V41R/D60aP/Y60bQ/
   T97aI/L97bA/C122S/Y149R; or
R35Q/H37Y/R37aE/V38E/T39Y/V41R/D60aP/Y60bQ/
   T97aI/L97bA/H99Q/C122S; or
R35Q/H37Y/R37aE/V38E/T39Y/V41R/D60aA/Y60bP/
   T97aI/L97bA/H99Q/C122S/Y149R; or
R35Q/H37Y/R37aE/V38E/T39Y/V41R/D60aT/Y60bT/
   T97aI/L97bA/H99Q/C122S/Y149R; or
R35L/H37D/R37aS/V38E/T39Y/V41R/D60aP/Y60bD/
   T97aI/L97bA/H99Q/C122S/Y149R; or
R35M/H37G/R37aD/V38E/T39W/V41R/D60aP/Y60bD/
   T97aI/L97bA/H99Q/C122S/Y149R; or
R35Q/H37G/R37aP/V38E/T39Y/V41R/D60aP/Y60bE/
   T97aI/L97bA/H99Q/C122S/Y149R; or
R35A/H37G/R37aE/V38E/T39F/V41R/D60aE/Y60bP/
   T97aI/L97bA/H99Q/C122S/Y149R; or
R35Q/H37S/R37aE/V38E/T39Y/V41R/D60aP/Y60bS/
   T97aI/L97bA/H99Q/C122S/Y149R; or
R35Q/H37T/R37aP/V38E/T39Y/V41R/D60aE/Y60bD/
   T97aI/L97bA/H99Q/C122S/Y149R; or
R35Q/H37G/R37aE/V38E/T39H/V41R/D60aP/Y60bA/
   T97aI/L97bA/H99Q/C122S/Y149R; or
R35W/H37D/R37aS/V38E/T39Y/V41R/D60aE/Y60bS/
   T97aI/L97bA/H99Q/C122S/Y149R; or
R35Q/H37G/R37aE/V38E/T39Y/V41R/D60aP/Y60bT/
   T97aI/L97bA/H99Q/C122S/Y149R; or
R35W/H37P/R37aN/V38E/T39Y/V41R/D60aP/Y60bL/
   D97T/T97aE/L97bG/A98S/H99L/C122S; or
R35W/H37P/R37aN/V38E/T39Y/V41K/D60aP/Y60bD/
   T97aI/L97bA/H99Q/C122S/Y151L/Q192A; or
R35Y/H37V/R37aW/V38E/T39Y/V41R/D60aP/Y60bE/
   T97aI/L97bA/H99Q/C122S/Y151L/Q192T; or
R35Y/H37S/R37aP/V38E/T39Y/V41R/D60aP/Y60bD/
   T97aI/L97bA/H99Q/C122S/Y151L; or
R35W/H37P/R37aN/V38E/T39Y/V41K/D60aP/Y60bD/
   T97aI/L97bA/H99Q/C122S/Y151L/Q192T; or any of the preceding polypeptides in which the amino acid residue at position 122 is not modified and is cysteine (C), by chymotrypsin numbering.

18. The nucleic acid molecule of claim 1, wherein the encoded modified u-PA polypeptide comprises the amino acid modifications corresponding to Y40Q/V41L/L97bA/C122S, or Y40Q/V41R/L97bA/C122S, or Y40Q/V41L/L97bA, or Y40Q/V41R/L97bA.

19. The nucleic acid molecule of claim 1, wherein the encoded modified u-PA polypeptide comprises the amino acid modifications corresponding to R37aS/V41R/L97bG/H99Q or R37aS/V41R/L97bG/H99Q/C122S.

20. The nucleic acid molecule of claim 1, wherein the encoded modified u-PA polypeptide comprises the amino acid modifications corresponding to T39Y/V41L/L97bA/H99Q/C122S, or T39Y/V41R/L97bA/H99Q/C122S, or T39Y/V41L/L97bA/H99Q, or T39Y/V41R/L97bA/H99Q.

21. The nucleic acid molecule of claim 18, wherein the encoded modified u-PA polypeptide further comprises the replacement corresponding to H99Q.

22. The nucleic acid molecule of claim 1, wherein the encoded modified u-PA polypeptide comprises the amino acid replacements
R35Q/H37Y/R37aE/V38E/T39Y/V41R/D60aP/Y60bQ/
   T97aI/L97bA/H99Q/C122S/Y149R; or
R35Q/H37Y/R37aE/V38E/T39Y/V41R/D60aT/Y60bT/
   T97aI/L97bA/H99Q/C122S/Y149R; or
R35Q/H37Y/R37aE/V38E/T39Y/V41R/D60aP/Y60bQ/
   T97aI/L97bA/H99Q/Y149R; or
R35Q/H37Y/R37aE/V38E/T39Y/V41R/D60aT/Y60bT/
   T97aI/L97bA/H99Q/Y149R.

23. The nucleic acid molecule of claim 1, wherein the encoded modified u-PA polypeptide comprises the amino acid replacements R35Q/H37Y/R37aE/V38E/T39Y/V41R/D60aT/Y60bT/T97aI/L97bA/H99Q/C122S/Y149R, or R35Q/H37Y/R37aE/V38E/T39Y/V41R/D60aT/Y60bT/T97aI/L97bA/H99Q/Y149R.

24. The nucleic acid molecule of claim 1, wherein the encoded modified u-PA polypeptide comprises the amino acid modifications corresponding to R35Q/H37Y/R37aE/V38E/T39Y/V41R/D60aP/Y60bQ/T97aI/L97bA/H99Q/C122S/Y149R or R35Q/H37Y/R37aE/V38E/T39Y/V41R/D60aP/Y60bQ/T97aI/L97bA/H99Q/Y149R, wherein the unmodified u-PA polypeptide comprises the protease domain set forth in SEQ ID NO: 2 or SEQ ID NO: 5.

25. The nucleic acid molecule of claim 23, wherein the unmodified u-PA polypeptide consists of the mature u-PA set forth in SEQ ID NO: 3 or SEQ ID NO: 6.

26. The nucleic acid molecule of claim 1, wherein the encoded modified u-PA polypeptide comprises the sequence of amino acid residues set forth in any of SEQ ID NOs: 8-44, 171, 176, 183, 184, 198, 199, 208, 211, 216-219, 221-228, 230-233, 240, 242, 243, 249, 260-265, 267, 268, 270-273, 275-292, 299, 300, 307, 309, 311-315, 324-326, 329, 330, 335, 337-341, 346-351, 356-360, 363-365, 368-374, 376, 377, 381, 382, 387, 389, 390, 397, 398-404, 417, 436, 445-448, 466, 469, 475, 481, 484-487, 494-496, 498, 500, 503-511, 513-520, 523, 534, 535, 538, 540-547, 550-553, 555, 557, 561, 562, 564, 565, 568, 576, 584-587, 591, 592, 594, 595, 597, 598, 600, 601, 603-608, 611-625, 627-629, 633, 645, 647-651, 653, 655-658, 661, 663-722, 724-729, 731-754, 792-802, 807, 818, 820-824, 826, 827, 829-836, 839, 841, 842, 849, 850, 855, 868-879, 881-884, 886, 891, 893, 900-904, 921, 924-926, 932, 934-940, 942-944, 946-961, 963, 967, 972, 973, 975, and 977-987, and each of the preceding sequences with the C122S replacement or in which the amino acid residue at position 122 is not modified and is cysteine (C), by chymotrypsin numbering.

27. The nucleic acid molecule of claim 1, wherein the encoded modified u-PA polypeptide comprises the sequence of amino acid residues set forth in SEQ ID NO: 21 or SEQ ID NO: 18 or SEQ ID NO: 987.

28. A nucleic acid molecule encoding the modified u-PA polypeptide of claim 1 that is conjugated to another moiety or polymer or non-protease polypeptide either directly or via a linker.

29. The nucleic acid molecule of claim 28, wherein the moiety or polymer increases serum half-life or reduces immunogenicity or both.

30. The nucleic acid molecule of claim 1, wherein the encoded modified u-PA comprises a cysteine at position 122.

31. The nucleic acid molecule of claim 28 encoding a fusion protein; wherein the encoded fusion protein comprises the modified u-PA polypeptide linked to another polypeptide directly or via a peptide linker.

32. The nucleic acid molecule of claim 28, wherein the encoded modified u-PA polypeptide is conjugated to serum albumin either directly or via a linker.

33. The nucleic acid molecule of claim 32, wherein the encoded serum albumin is a human serum albumin (HSA) that comprises the sequence of amino acids set forth in SEQ ID NO:991, or that has at least 90% sequence identity to the sequence of amino acids set forth in SEQ ID NO:991.

34. The nucleic acid molecule of claim 28, wherein the encoded modified u-PA polypeptide is conjugated to a polymer that is a polypeptide, wherein the polypeptide is multimerization domain.

35. The nucleic acid molecule of claim 34, wherein the multimerization domain is an Fc domain comprising the sequence of amino acids set forth in SEQ ID NO: 50 or SEQ ID NO: 992, or that has at least 90% or at least 95% sequence identity to the sequence of amino acids set forth in SEQ ID NO: 50 or SEQ ID NO: 992.

36. The nucleic acid molecule of claim 28, wherein the linker comprises Gly, or Ser, or Gly and Ser.

37. The nucleic acid molecule of claim 28, wherein the encoded modified u-PA polypeptide is conjugated to another moiety via a linker, wherein the linker comprises the sequence of amino acid residues set forth in any of SEQ ID NOs: 1001-1003, and 1024-1029, multimers thereof, and sequences having at least 99% sequence identity thereto.

38. A nucleic acid molecule encoding a fusion protein, wherein:
the fusion protein comprises a modified u-PA polypeptide encoded by the nucleic acid of claim 1 and a non-protease polypeptide or a portion thereof, and
the encoded modified u-PA polypeptide in the fusion protein is fused to a non-protease polypeptide or a portion thereof.

39. The nucleic acid molecule of claim 38, wherein the non-protease polypeptide is selected from among one or more of a single chain antibody or other antigen binding fragment of an antibody.

40. The nucleic acid molecule of claim 38, wherein the non-protease polypeptide is an antibody or antigen binding fragment thereof that is an anti-type II collagen antibody scFv fragment.

41. The nucleic acid molecule of claim 38, wherein the non-protease polypeptide is selected from among one or more of serum albumin; an Fc domain from immunoglobulin G; a Hyaluronic Acid Binding Domain (HABD); a GST (glutathione S-transferase) polypeptide; a His-tag; a Small Ubiquitin-like Modifier (SUMO) tag; the influenza hemagglutinin (HA) tag polypeptide; an antibody to HA that is 12CA5; and a heterologous signal sequence that is a thrombin signal sequence, or is a mouse Ig kappa chain V-III region (IgGK) signal sequence, or is a human Interleukin-2 (hIL-2) signal sequence.

42. The nucleic acid molecule of claim 41, comprising a sequence of nucleotides encoding a signal sequence, wherein the signal sequence effects secretion of the fusion protein and is removed from the fusion protein.

43. The nucleic acid molecule of claim 38, wherein the encoded fusion protein comprises an activation sequence that is a heterologous activation sequence or a u-PA activation sequence.

44. The nucleic acid molecule of claim 43, wherein the activation sequence is a u-PA activation sequence or a furin activation sequence.

45. The nucleic acid molecule of claim 43, wherein the activation sequence comprises a cysteine, and the encoded modified u-PA polypeptide in the fusion protein comprises a free cysteine, whereby, upon activation, the resulting activated u-PA polypeptide comprises two chains.

46. The nucleic acid molecule of claim 44, wherein the activation sequence is an activation sequence set forth in any of SEQ ID NOs: 995-998, 1041, and 1044, or a sequence having at least 95% sequence identity to a sequence set forth in any of SEQ ID NOs: 995-998, 1041, and 1044.

47. The nucleic acid molecule of claim 38, wherein the encoded fusion protein comprises an activation sequence, a modified u-PA polypeptide, and HSA.

48. A nucleic acid molecule encoding a fusion protein, wherein:
the encoded fusion protein comprises a modified u-PA polypeptide of claim 1, or a catalytically active portion of a modified u-PA polypeptide of claim 1, and a non-protease polypeptide or a portion thereof, wherein:
the non-protease polypeptide is a fusion partner;
the fusion partner is an albumin comprising the sequence of amino acids set forth in SEQ ID NO: 991, or is an Fc domain comprising the sequence of amino acids set forth in SEQ ID NO: 992, or is a hyaluronic acid binding domain (HABD) comprising the sequence of amino acids set forth in SEQ ID NO: 994, or is an anti-type II collagen antibody scFv fragment set forth in SEQ ID NO: 993, or is a fusion partner having at least 95% sequence identity to the polypeptides set forth in any of SEQ ID NOs: 991-994; and
the encoded modified u-PA polypeptide or catalytically active portion thereof is fused to the non-protease polypeptide or a portion thereof.

49. A nucleic acid molecule encoding a fusion protein, wherein:
the encoded fusion protein comprises a modified u-PA polypeptide of claim 1; and
the encoded fusion protein comprises the sequence of amino acids set forth in any of SEQ ID NOs: 1004-1011, 1014-1019 and 1036-1040 or a sequence having at least 95% sequence identity to a sequence of amino acids set forth in any of SEQ ID NOs: 1004-1019 and 1034-1040 that includes the modified residues.

50. The nucleic acid molecule of claim 38, wherein the encoded fusion protein comprises the sequence of amino acids set forth in: a) any of SEQ ID NOs: 1004-1011, 1014-1019 and 1036-1040, or b) a sequence having at least 95% sequence identity to the sequence of amino acids of any of SEQ ID NOs: 1004-1019 and 1034-1040 that includes the modified residues, or c) a sequence of amino acids of a) or b) lacking the signal sequence and/or His-tag and/or SUMO tag.

51. The nucleic acid molecule of claim 50, wherein the encoded fusion protein comprises a) the sequence of amino acids set forth in any of SEQ ID NOs: 1006, 1007, 1009, and 1010; b) a sequence of amino acids having at least 95% sequence identity to the sequence of amino acids set forth in any of SEQ ID NOs: 1006, 1007, 1009, and 1010; or c) amino acid residues 21-505 of SEQ ID NO: 1006, 21-864 of SEQ ID NO: 1007, 21-382 of SEQ ID NO: 1009, 21-516 of SEQ ID NO: 1010, 32-516 of SEQ ID NO: 1010, or a sequence having at least 95% sequence identity thereto that includes the modified residues.

52. The nucleic acid molecule of claim 51, wherein the encoded fusion protein comprises a heterologous signal sequence.

53. The nucleic acid molecule of claim 50, wherein the encoded fusion protein comprises a) the sequence of amino acids set forth in SEQ ID NO: 1015 or 1019; b) a sequence having at least 95% sequence identity to the sequence of amino acids set forth in SEQ ID NO: 1015 or 1019; or c) amino acid residues 21-1022 of SEQ ID NO: 1015 or 1-1002 of SEQ ID NO:1019, or a sequence having at least 95% sequence identity thereto that includes the modified residues.

54. The nucleic acid molecule of claim 53, wherein the encoded fusion protein comprises a heterologous signal sequence.

55. The nucleic acid molecule of claim 50, wherein the encoded fusion protein comprises amino acid residues 21-431 of SEQ ID NO: 1005, 21-663 of SEQ ID NO: 1011, 21-1022 of SEQ ID NO: 1014 or 1015, 21-876 of SEQ ID NO: 1016, 1-1002 of SEQ ID NO: 1019, and 21-663 of SEQ ID NO: 1036.

56. The nucleic acid molecule of claim 55, wherein the encoded fusion protein comprises a heterologous signal sequence.

57. The nucleic acid molecule of claim 38, wherein the encoded fusion protein comprises a multimerization domain that is an Fc domain.

58. The nucleic acid molecule of claim 57, wherein the modified u-PA polypeptide in the encoded fusion protein comprises the replacement C122S.

59. A vector, comprising the nucleic acid molecule of claim 1.

60. A vector, comprising the nucleic acid molecule of claim 31.

61. A vector, comprising the nucleic acid molecule of claim 39.

62. A method of treating a disease or condition mediated by or involving complement activation or for reducing the risk of developing the disease or condition, comprising administering the nucleic acid molecule of claim 1 to a subject with the disease or condition or at risk of developing a disease or condition, wherein the nucleic acid molecule encodes a modified u-PA polypeptide or a fusion protein comprising the modified u-PA polypeptide.

63. An isolated cell or a cell culture, comprising the nucleic acid molecule of claim 1, wherein the isolated cell is not a human zygote.

64. A method of producing a modified u-PA polypeptide or fusion protein comprising the modified u-PA polypeptide, comprising culturing the cell or cell culture of claim 63 under conditions for expression of the encoded modified u-PA polypeptide or fusion protein.

65. A pharmaceutical composition, comprising the nucleic acid molecule of claim 1.

\* \* \* \* \*